United States Patent 11,401,555 (GENETIC POLYMORPHISMS ASSOCIATED WITH STROKE, METHODS OF DETECTION AND USES THEREOF) - sequence listing, part 7

SEQ ID NO: 434 - DNA, 50058 bp, Homo sapiens
cctattagcccatagagtcccgttgggaagacaaagactggcctatagtctggtgggcagagcctgtgttggattttggccctcacctcccccagaatgcatgtagaatgtgaactgtctaattgcaggagtggccttgcagcctcatttcctctctctgtgctacttggcccattaacaccctgcgtgcaacaccagcctgagccttgctcccagatcaaccagacatggggctaagtacatccagccaaactatcactcagccaggtacttgctttcaggcacatcaactttagcatcagcttgtaaatatgttctctcttcctaagcatttgttcttgttgaaggagcacaaagtgggacaattaattgagactggcgtgtgtgtgtgttgaggggggtgtggtgggaatgtcatggaaagactctccaaataaatgagattgactcaaccctaagatctgtcctgagaatcgggcaggtgaaggtaatctaccaactgcccatttcatcttcttatcaagtagtcttgtcccatacaaactgaggttccttccatagcataatcaaaagatgccctacaataaatataaagcaaagtagcccctgaagtggagttgcagatttattgtatccttcattgcacttcaagagaaagtaatgaagagcccactatgtgcaaggcaccaaggggaaggcaggctgtgaggctgaaggaaactacttattctaccttaaagttcctttcattgaggagacacacatagaaatgtcaactgtgttgcaacctggagtaacgtagagtccaaatgacatacaagtgctgtgttatgggaccgtagaagacaaagactgacttttattgggggatatttaaaaaagaggaggtagtgtctaagctggcaattgacaggcaaatagggttctgaaatatggaaaagtagggaaggagttccagatggagacaacagcatgcccaatgtggcacagaggggcatgagggtggggcatggttaggtagggactgggtattacagagtggccaggtctccagcatggggtcacaaattcaaatatctacaaaacccaagtagttaatatgagaaaaaagtggaaggcaacagggggcagacaggactatggaaaagaaggaaaaggtgcccttcctagtgggggaatgagagtggcagttactcagctccagttgcttattgccatgtgttggggggaagatctagaattgccagaccttttgcaagagaatccagaaattcatttttttaaaatgacgaagttctctgatttttaatacagtatagcgaaacacaacacctgagggcagctttcagtcattagtgtgccaggtgggaccctggtctggagagtctatgggaggagtttgggaggttggtactcacccagaacaccagacaagccgctggtaaatgtgtaattgataatgggatatttttcttctatctcccagaagtcagaaagattccttcctgcaaaaatcacaccaacagggtcagatcttgggtttcatctgctggacagttttgtctatttctcagcccagagagcttgtcaaagaatgtctagtggtttacctgactttcctgtcatcacacagatgaagatgcaatctgattcattgctttgattcactgtaagacaaacgagtatacaataagacttagccatgggtctgaagctgtaagtctttgattgaaatgaaaattaagttgaaagtacctaacttaggataatataggaaaataagcctgactctttactcttaaggcagtcctcattttccaatttctttattttatttggctgggtttgggggatggtgtagtggctaaggcagagtctctgaggtcagcttctagggttacatcagctctgccacttactagctatgcaaacatgaatgaattgcttgacctcttcaggactcagtttgcccctttataaaatggtgaaaattcaaatcccacaatccctcatttgtaattcccaaatgcccacatctctgtaagacaacatgttttgtgtgagcttggtacccaaatttgaaaaatgtgaagctatgatagtttttatctatcctacttagtgtaaagagctgaacgttttaccaaattactactaacgtgtttgattacactgggcttctctggatgctgttggagaagttacatcaggtaggatgtgcacactttattagatcttcaaagcctgaaaacttctgaattcctaaacatacttttccctgacgatgctgcctaaagaactgtggacatggggttgcatgtctctcataggataacaggaaaatccaaggagataatgggagtgatgcactaggtatggtgcccagcagatagaagagcacagtagccagagtaatcattattgttattattaatgtattactatgattatatatattaggatagtgacataagagcacaggctaagagccagatcacctggtttagaattctgcttctgcagagtgattttgagcaatttacttaacccctctgtgacagtttcctcacctgtcaagtagggataaatatagtagctgccccaaaaggttgtagtgaggatccaatgagagaatacatggaaagcccttacaagattatctgacacctaatgatagctgttactatttctctttctccctccctcctgcttttaaaacagtagctgctccacagtgcatcacaccgtctttctgctgagaccagttgttggactgttgaatagatccttgcttttcaaagtgggtccctaaggaaatgtgattttcctgggggttacatgaaaccaccttataaatgaggtgtatcattcttaactgtactccaaacatgggcttaggctccatatagatttaaacctgaattctggcaccaaacttaagcaaaatattcaacctctctggatctcagttttgtcctccttaaaatgggggtatatctactcaccagatgttttcttgagtctgcctacgttccttaaacttttgagctttggattcttcctccaactttgtggatcccagaaatatgaagacttaaatattggtgcatttactggtgtggaaactggaccacactgattatctaaataaagattacatgaacgtttctggcagcctggcctatagcaggggttggggtgaggaacataatatgcttcattatctaccacaacagatgctaaacctcaaagttgccaaagcgttttcaagatgaacacacctgagaggatggaggttgacttaaaaatctctgtgaggtagctggtagaattgccgatgatatctaccagtagagctgtaaaatctgcaagacaaatttaggaggtttaaatttctgcttcagagacaaaaggagaaaagtatactgtgtttggatttttcagagtaaattttacaagtttgatttagtttagtgtattgaggaatatcaacaatgatacagagaaatactactaattctaaaaaatgaaaagtcttgatttcaggccggaaggaaactttggatccactgttaaaatcccctttcttcttctatcatcctctctcccaaccccttctctgctaacatctaagagctatgaagggccacattgttgaataatggtctttctggcggcttttccccattgtttcgtctaattgtttttagaatgccaactccatctgataggaagcagccccacagatatgtaatgtaaatttacagacttgggggttggaaaatgaaaatgcaatgtggaatttagtggtgagttataaactatgaacaatagagacaagacaagacactttctaaaattatcaccaggaacctttccttctgccccctttttaaaggaactgatggtggtgctggtggggagtggtgtctgagataactttttcagcatttcaggttatagaatcattgtgaactttctttctcagctgggtttgaacagggccattgcctgacatggtgggcactattgactgtgaaaattcctaatattcttctagtcaaacagctgtcatctccttctttgttcatttatggctttccacgatccagcaaattcttgacttctaaacaaggcgaatgtgtttgaggagccccagtcattttctaaagaggaagcttcttgggtccagtggatgatttcccatcatgctgtgtaaatgctcctttcactcattaatgggatcaggagtttgtgcaggagcaagctaacttgaaaatacagaaccaagagaggtaggaaaatgttatgtgacaattagtggaatgtgtagccaagaccaacagatgatgggcactactatgcaagaaccaaagccatgaggtggtcttactatatccgcacaggcacattttaacctcctggagggagaacacctatgcagtatgtagtatacctatgcaggtatagacacctgtatatgcagaaggtaggcaaacatgggcaccctctttctctctctttttttttttttttttttttgagatggagtctcgctctgtggcccaggctggcgtgcagtggcgcaatctcggctcactgcaagttccgcctcccaggttcacgccattctcctacctcagcctcccaagtatctgggactacaggcgcccgccaacacgcccagctaatttttttgtatttttagtagagacagggtttcaccgtgttagccaggatggtctcgatctcctgaccttgtgctccacccgcctcggcctccttctctgtctctttagaccagtctgttcttagtcatttgtggaaactgaggaagggtattatctcttagttattccatatattttctttctgcttctaaaaattctcctttgtttattaatccatttatctaataaatattcatcgagcatttgcagtgtgccatacacttaccaggtactggagagttgtgtaagacataaagaagaagctgaggttagtggtgaagcaagattcataaacagaccaataaaatgcaacttggaagttgttatcaattttgcatagaagctatgagcatggctttgaagccacacacaaaacatggagtccaggttttgcccaaggctcagaaagatgatgtaacttgtccaaagttccagagtacgtggcagagcttagatttcagctgaggtctgtcttgggccaaagcttccactattcccggtattcttaccaccactcatgaaacctcttgctcaatgcattttgtcaattctccctttagaactgttttcacaatctgctttttaggcttggaagaaagccagttattattaactcaaagatattctttgcatttatgaaagtttgaattatctaatttactagcaatgatcaaaatgaatgattcatgactaccttcatacataaatagaaggtagaagtacaaaaccctttttacctatccatttggtaatgatttaagactgtctcttaacactcagtgttggcacatgtgagtgggaaaacataggcattcaaacattgttggtaagactgtaaacgtatgcaagacttttagaagacattttggcaattcaaatcattataatattgtttccctgtcagccaacaattctattttgcgggctttattctgcagaggtaattgggcaagtactctaagtgattttacacaggtgttcatcacagcattgtttataattgcaaaaatatgaggaattagccaagtttccaacaagaggagacaaattaaataaatcatggtacattctttcaatgaatactaagaattcatgtgaaggatgaggcatacttgcattcactggaatgaaatggtttttttaagacatatgggttagtttgagagtagattataaaattgcataaaaaatgaaagatactgatggttgtctttcaatatcgattctcccaccttcctttagtaagacagtatcaaattttaattgggaacgtgatggtttaaagcaacgactataatttcaagcttgctttgtgggtgagtgtagccatgagattaaattctgggaaataggatgtaagagggagaaatgtgaatggtttccaggctgtgagttcatagtgaatgtgcatgccttctgggatggtttggatctgtgtccttgcccaaatctcatgtcaaattgcaatccacaatgctggaggtgaggcgtggtgggaggtgattggatcatgggggcagacttctcatgaatgggttagcaccacgtccttggtgctgttctcatgatagtgagtgagttattgtgagatctgcttgtttaaaacacctttccccttgttctcccttgctcctgctctagtcatgtaagatctgcctgcttctacttcccctctgccatgattgtaagtttcctgaggtctccccagaagctgagcagaagcactcatgcttcctgtacagcctgcagaaccatgagctgattagacctcttctctttataaattacccagtttcaggtatttctttatagcaatgtgagaatggactaatacactttccaaatcctttctcctcttcattgtagctggagtgtgaatgtgctggcaacctaccttaggctatgagaacacagatcattatgaaaggcaaagcaacaagctagaaggagcctgggccccaaaaccatcaaaccattagagcagccctggcatgtctacatgcccagactatcagacatgaaagcaattaacttctaccttctttaaactaggctattttggagtcatttgttatagtagcccaccctgtattctaaataatgcagagaatgggttcctatatgtagagcaggatgtctacactgatgggtagatattagctggggtacataggtagataggtaggttagataagtagcttagatgacaggttggatagataagtgggttatataggtagtgtagacagccttggatagcatttattagcatgttaatagtgactaccagtggatggtgggatatcagctatttctggtttcttagttttcctgtccatgttgcatagcatcttgatatcacagtacattatttttaaaattaagaaaacttaagccagtttcatttaggaagaaaaaaaagggaaaatatgcaaatataccctcaaaggagggctttagatcagagttgaaaacattaaaaagaaaatgatccagatctaaagatcatccacaaagtcaccttccccgaaggtgttgagcaacggcaagttgttggcctacgtgtacagcctctcatggtagcgctgtgacttcttgtcaaacctggcaaaagttgctatgacctaccagaggaacaccaggcaattttatcagtagataatgatccatggatcattcttttcatataattgttgcaagtgtgtgaaaatatgatttgactcatgaaataaaattataaactttctccaggcagatttaactttttaaatcttatttttatctttcacacaatcaggatagggactcacccagcacagacttctatcctcagcaggggttaatgaaatggtgagaaaggcatgattatgaagaatttttttcctcacaaatgtatttgttgaagagattcacagggtaaattacataagataatagacattaagcactcattgtagcatctcgcatatagtacttattatatattagtaattctttcctttaatattttcacaatatttgttttagaaattctactcagtgggggaaataatctgaaacagggaagagtttacgcacaaagatgtccaaggcaaaattatttatattaagaaaaacctagatccactcaaaagtctaagaacagcatagtggctaagagaatgcttgcattcactggttacatagtcattacaagtgtttaagaagagtttgtaatatggtggaagggttaatattagactaagtggggaaaagtacaagaggctttggttgcctttagtgcttgcttcccttacaatctcgtatttaacaagcagccagaaggattcttttaaaatgtcagatcatgtcccttccctgtgcagacaatcacaatggcttccttcttattccgggtgaaaattagaatcctcgcagcagaccttaaacttctatatgatctgcaacaccctccccactttgccctcaccaatcagagctaatttcctatagctctgtcctggctaacctgctccagttatgctggcttctctggtcctcatgctgctgcttaggcctttgtctggaccactgtccccaggaacaaccacagggctggcccctcacatcctgaaggtcacccctcaaccctcacttcatttggagaagactttcctgaccaccctacacacagcaatatcccccactgtgacttttccctccggctttcccctgcttcatggttcccatggtcaggctgtcagcccacacaccatgtacttgcagtacatttatttactccctgctccccgctaggaatctatgtcccacgggagcaggaggtgtgttcactttgctctgtgtgctttccccacacctagaagagtgcatgggtcatagtgcacgctcagatggaattactgaatgggtgaattaacggtgcaaaaattgtcacttttatttttcagtattctctaaaatagggaacacataatactttaaagttttatttataaaactagcatatgaacatactctccttgggaaaaaaaagttcagataatctaaggctcttttaaccaacattcttccactccaaaacacatactccaatcttcttttcaaagggaatcacctatctggtgcccacatatgtgttcttatcaataacattgtgctctttgtatttttgtgtaactttctttttctaattaaaaatctcttggaagcttttccatgcacaggccaaatttgagcactctcactcatttatgtattatctgtggctgtttttgaaagtttaattatgtgggagactacttaaccattttccctcatgatggatatttaggttgttcctcacttttgcaattaaaacaatgcttcatgaacattttcctcctgttgcttttgcacacacaactgtttttcactgggataatgaatgagcacatggttaagggtagtggataggaccatattttcctgtcttacattgaggaaaaacaaaaacttatctaaaaggacacaagcaaaattggaaaagctgcaagcctcatggtaagctgtacccacctgataagtcattggtccgattgtttaaacagtagcaataccttgtggggaatttggcggggtctactgtcttcaggttagaaactgtgaagagaaaggattcaacagagatcctaacacacagaccagccctgcaacacatccctaccaccaccaccatcaagaagagccagccagcactcactgttgtaaacagctacagaaaacttgtggaaggcgaaggaactgtaggaagtgacactcagcaaggagaagaacttcttgctatctgccaaaacataccagataaagagacagacagatgcctactaacgtaacaataatacaaataagtaaacagtccctagaaattaacaatgccaataaagaaaccaatgatgaaaataaagaaacaaacaaaaaagtaatacaaataaaaaataataaacaaagtaaaactaaaccaaaaagctgaagagtatgtatcatttgtctatatttcctgatccatcctcaagctgtggcaactctctaagaaagattcccaaggcatattaggcccctgaggctgctgtaacaaattatcacaaacttggtggcctaaaacagcagaaatttgttctctcacagttctgggggctagaagtctgaaactcagtagggcaccctcccttcaagggctctaaaggagaatctgttcttgcctctctcagctctggcggctgcctgtgtcccttggcttgtggccacatctctctctgttctatcatcacatggtcttttcttctgtgtgtgtctcctttgcctctttcttgtaaggacccttgtggtggcatccggcacaacacaaataatcctggacaatggcctcatctcaaaatctttaactcaatcaatctgttatcacatcaggtgatattcactcttttgacatataaagtagtattcacagattctggtaattacaaagtggatatctttggccattttcagtctactacacaaagaaaggggatttttttttaaaccaggaatactaacataaacaatcaggtttaggaatacatgcatgagcatcttatctactctccatcagtgcctgttcttagtttatatctggagcacagtgcagcagagggagatctttccagacctggtctgagaatcacccacctgcatcaacacacctttaataggtgcacctattaaaagggcacattcctggatgtgatcccaggtctactaaatcagatggtgaagaaaggggaaaggtgggtatgcccagggttctgaattttaacaaagttctcaggtgaatttttttcttttttagacagggtcttgctctgtcactcaggctggaatgcaatcgtgcagtcacagctcactgcggcctccacctctcaggctccagtaatcctcccacctcagcctcccaaagcgctgggattataggcatgacccactgtgcccggtctcaggtgatttttattcatataaatttgttacccactgtgatggtggatggaatggcagaatcattaaactttggtgcacgcaaatcaccagtggtgcccattccccctcggctctctggctattgccctctggagaccccaatgccatacactgagcgggaaccagactctgtatttaataagctccttagaagaatggggtatacaccaaaatgtgaatactccagtactcagtttttttgatgataaaaatcacaaatagcacttggtaaaaatatacatttgggccccttcaaagatcagctggatcagaatctccagagcaggaacctggggagatgaatatttaataagtacatcaggtccttcttattgtgcaacaagtttgggaaactttgggctagatcacaaacctggattaaacagttctgaattccaactctatgtggcaatgggcacgcctcaacgtctgcatctagaaaatgggagtgagagtaccaccacgtggaggttatacaaggattaaattagtcattggaagagttttgagctcctcgaagttatgacatttgagtttctgcaaaatttcacagagcccagtgcagggccttgcagaggaaaggacaggattaacagttcagggctggaagggctaaatgttttgcagcccatccctccatctgataattcagtctctccacagcaccctctacaggtagatcactgccttcttatcgtgcacctcccaaggcagccctatcctcggcaactctcatgagagcaaattggaggcaggagctatatctctgtaatttacagcaacaggcattgggacagggatggataataatgttgatgggtcaatgtctaagtgaacaagtgtagagccaccaagcacagttgtgcagtgtgtgtattgcacaatcctagggaatgccatttacatagacctcaacactgaattggcattctccatcccccttattctaaataacatgtaccattacctatttattatgtttattgtttgtttttggttactccttcacccaatagaatggaagctctcccaggccaaagatttttggtttttatttactgccttatcctccaatatttggaatagtgcctggcatgtgataggtgttctatgaatattgattgaagaatgtgagaataaatagtgaaggcagtgaggaatgtacactagggatcattcaggctttgctgtcattcactaagtatgtgttacatacaaatcattttgctagacgctaaagaacacagaaagaagattacaataatattgtcttaaaaaaagaaatccagaatcatattaacttaatcaatgagtaattattgttagtttatggcaacagagttacaattacaaacataccatgtctgtattgcaattcgctctcaaaattcttgtaaaccttctacgtcattttgagtaaggtaggacaatgaattctgcattctgcttttgtttttgttttttgaggcaaagtctcactctttctctcaggctggaatgcagtggcattaccacagctcactacagcctcgaccttctgggctccagcaatcctcccacctcagcctcccgagtagctgggaccacaggcatgcaccactgcacgcagctaatttttgtattttttgtaaagatggggttttgtcatgttgcctaggctggtctcaaactcctgagctcaagcagcttcccaaagtgctgggattacaggcgtgagacactgagctcagcctattctccactctgaacaccgagaaactgacacacagaagtgaagtgtcttgtcaaggcaacagaaaggttcagaaaagacactggtacaagaaaaaaaaatggacctggattgtgcttttaaaatatgattaccttttaacgctctactgagcatcccattcacaagctctgtcaggttaagcgcggacagatcgattgaccttgcgggcagctctgaaagagattcagagataatgtcactggcaggcttttctcggcaagagaaaaagtttctcatttccaaacttcaggcagatattcaacttctttgcacatgtgctgaaaacaaaccaagtgccaggcacgaggggttccaagttaagttaagaggagggtctcgacctcaggaggtaacagtcaacaaagtgacaaatatagataagagaaattccaatgaagcacaggaaacatgaacttttagtgacaattgcatctctgcatttggagagactcgggactcatataaaaggtatctcaagcataatgggaagcccaagggcattgcaggagttctcagcagctctgtgtttgaaaataagtaccccatgtaaacgtggggtccacacaccctggctgagcattgacatcacctggaaatatacatttttttaattacacaattccagtacctggccttcatcttcagaaattcagaattaataggtccaggatgtgacccagaatggagggagaaatctcccaggtgtagcaggagtggcagtgtgcagtgagtggagttaaaattcccacttcccccggctattccttaatgatttggaaactggccaggagcagtggctcacgcctgtaatcccagcactttgggaggctgaggtgggtggatcacatgggatcaggagtttgagaccagcctggccaacatggtgaaaccccatagctactaaaaatataaaaattagctgtgtgtggtggccggtgcctgtaatcccagctacttgggaggctgaggcaggagaatcgcttgagcctgggaggcggaggttgcagtgagccaagatcgtgctattgcactccagcctgggcaacaagggtgaaactccatctaaaaaaaaaaaaagatttggaaacaacagttgacaagatggaaatagttgttgatgctcctctttattcaaacattgtcttcttcaacttttacttaatgatcagataatgattaaagagatgacgttctcgccactgtgggaaagaacagaggtctagagaagtggaggaattgctctgcaacccagacaacccaagggatttgggggagcggcactcacccgtcgtagcaagaaatgccacccccttctccttcctctcttcttctctaaggccagacactgggaaggagacagttttcatgagaaaaatgtgagtggtccagttcctacccccaggaatggaagaagccttggaagcctctttggcctctgctctccgtgtgagagtcactggcggacactgaggaaaggcagatcacagactcttctgcatggccctaatacagtttctaatctctgtggggtggctgtggcctagaaatgcacattttaataaatcagcttggcgattctgatacagggggtctaatttaccccactctttaaccaagtaggaaaactgaggcccagagaggagaaaaaccttgcttaaatttgcacaactgagcaatggtaataaagggttcagaacctactttctagaactgtagagcagtgcccaaaatattaggtctcttgcctacttaacaaatttcatgcgaccaaaggagaaaatgtcaaagaaaaatttgaaatttcaaaggcattcattcgttcttcattggttcattcaacaaatattcactgagggccaagctatatgctaggcaatgtgaactggtaaaggggaatgaacccggtctccagctccatggggcctcctgtgtgtgatttggtcagggaggaggagactcacatgtcgtgacaagagaggagtgtcaacacggtgtgggagcacagggcactagcctggtgtcaggggatggagaaggccttcttgtggaagtgacattaagcagagaccagaaggatcagttattttggatcacatgctatagaatcacactgcacttgtaactacgactgttggagtggtcatttttcatgttatacctggatggagaaggtgcattattttacattttattttattaaattaaatgagacaagcaacatatcttattggggtcacagagaggttcaggaaagaagctggtacaaaaaaagctagtatcacatgtaacatgaaaaatgaccattgcaacaataggtaccagcaggatggagaaggtgctgtattttacattttcattttgcaaatagaaaacaacaagccacagagtctgaaaaatgtgccctgcattacagagtaagtcaggatttagggctgcccgggaatgtcccatctttttccttcttaacatctttatttccagacactgaaataaaagttttcatgaataaaatagtaacctgaaagtacagcctcaaacagttcataacatccttagaaatcatcttgtccaacactttgaagaatggataaactgaaatccccaaacttgatttgatgtacctaaatttgatgtaccatattgggctagtggctaagataaaatcagaaaagagcaatctcaactctttgtccatgttcttctccctcacttctttctattttactttttaatttattaaaattcatttataattttattgaaaaacacttaacatgaaatctaccctattaattttttttttttttgagatggagtctcactctgttgcccaggctggagtgcagtggcgtgatctcactgcaacctctgtctcctggggtcaagcgattctcctgcctcagcctcctgagtagctgggattacaggtgtgcaccaccacgcctggctattatttgtatttttagtagatctggggtttcaccatgttggtcaggctggtctcaaactcctgacctcatgatctgcctgcctcggcttcccaaagtgttgggattacaggcgtgagccactgcactcatcccaattaacagatttttaagtgcacaatatagtattgttacctattgttattatgttgtacagcagctctttagaacttattcatcttgtgtaaccgaaatttcatactcattgaacaacgaacttcccatttccctctcctaagcccctggtgagcacctttctattctctgcttctgtgagtttgactattttagatacctcatgaaagtggtatcatgcagtgtttgttcttctgtgactggttcatttcacttagcatactgtcctccaggttcactcatgttattgcatatggcaccgttttcttatttaagaccgaataatattgcattgtatgtatataccacatttccttttcctgtttatccgtcaatggacatttaggttgctatcttctgcttttctgataccatgttgaaactgagtcaagtcagctgttgcctgcttaagccaatttggccttttgccaattgccaagctttttggttaaatatcaaagcttctggggttagaggtaggtggggactctaactcccctttgccataacagggctactggaggcaacgggcttatgtcacaaaaggaagtctgagacagacatacttaagcagggcaaatgctgccaactagccagctgtctagcttgagtgaggccactgcaccccctcaggcacccgtgtggcactttacctgcgcagtctactctgcaccagctgctataagatctgcaggaggcacaatcaaccttgcttgtgacctgccaaggcaacagagtcctccatgcaggtgagggaccaggattatgtcagttcggggtctccaggcagcagggatgacccaggctaccaggctggcaggattcctacacctttccagccagaatggtgggccctgtgtcatcttcttcactgagcaccattttttttttttttttttttttttttagcactattcctttcaccaaggaaagaatatttctaccactccttgggttgattttgataacaatatttgaagtctgaactaaacaccagtggagcacagatttttgaacaggatgtaatacagagcatttttcaaataagttccctgacagattacaaaaagatatttttctatttttggataaaaagaccaccataataaaagctttaaaatagaaggttcctggcattttttgtacttcttaatgcttagtattttatcaccttttatccttcatgattacctgtggggcaggaattgttgttcccatttaaggagaagaaaattgaaagctcaactaagaaaaatatttatggaaagttatcctacttacacacaataaattggtacaattggtgctttcaggaaagggaagctgttggctgggggagcattttaactttatacgcttttgtaacttttgctatttgaactatgtgaatgtactaatttaaaataaatgagaatataaaaatcgtccaggtctggtggctcatgcctgtaatcctagcactttggaaggccgaggcaagtggatcccctgagctcaggagttcatgacctgcctgggcaacatggtgaaaccctgtttctaacaaaagtacaaaatattatccaggtgtggtggtacatgcctgtggtcctagctatcgggaggctgaggtgggagaatctcttgagcctttggggtggaggttgcagtgagttgagatcgtgccacctgactcccatctgggtgacagagtaagaccccatctcaaaataaataaataaataaataaataagtataaaaagtaacacaatttccatcaaaactaaaaccgaaaccaaaccaaaaaattgtactgcttgtttactaaaatttagaaacctgttcccagactcctcttgtcctttctgttgcaatgtagtcaccattgtactgcaaagtgaatttcatagcatcaagaaggaaaggcaaagaaagatgaaattattacaaaggtgatgatggcaagtaacggtaccccccattataaaatcttctatcaccaatggaatgttacagtctttgtggatttattaagatcacaaggattcaatgaaccataaagaaatgagtagctcacaggaaccattgttgtgactattagagtgttagatgcggatataatcgctgtcttatcagtagagaaagtcaggcttggggaagtcaaggaatttgcccaagaacagtgagctgaaaaggagcccttatcacccacttacctgttgtaggtaaaaaggtcattcccttctctttcttggcttctcctttgatgccagacactaaagtaaaaaaggtttaatcacagaaattataaccaagacataataccggagataatttgattcaacatacccattttacagatgagagaattatgatctggggttgtgaagtgacatttagtcccgcatctagtttgttcattcatttaatcatttcgtcatcaaatatttgttgaccaactactaatgatggatggtgctattgagtgccgagtgtttgctaggcattgtgtgtgctggaaaggcagacacataggaaaacaacattgaataccttgaagggaacggtgagggtgtgtaacagggggctgatctagtctcgggaatctggaagccttccctgagagggggcgttgagctgagctctgaagaatgaatagcatttgagtaggatttatctaattgggggaatatttgatgtatacagaacagcacaagcccagtgtctgaggtaggcatgagtattactttaaagaatggaaagaaggccaacagtgatgggggcataaagaatgaaggaggtggaggtggtaggaagcagggatggtgagggaggcagggtcacgcagagcctgaaaaggacctggtacactacacagagagaagtaggaactccgcaaataatttggggcagagggagagaaaagagggaggaacttggaagatgacctaacaagatttatgaaaagatcactcaggctgattggtggtgaatgggtcatggagagacaagaggagaagctggtttggaaagctgtctcatggtctgggaaagggaaaataatgttttggacaaaggtggtaacagtgaaggtgaagagaattcttttgcatagatgggacttaaatgcaaaaagtcaagggaacaacagaagtagggaagttattcttgccattttgaacaaattcatttggattctgggcagaaatgttggctgctgaggttctctaaagcacagtgaatactccaacttattatacagaacagacacttgcagaactccagctagacccacctgtgttccaaagggacaagacacatgccaggcccatgcacagcttcattgaaggaccacgtgacaggaagcccagcatgcttgtgatactctggcccacctggaatgaagcaagcaaacacttaggaaactaagcacatggatgcagaccttcctttgagaacagtgcgtgaggaatcattaaaatcacaatctgaaaaaggctttgtactaggttaggagaggttaggaagctaaggtaacaaattaactccacaatttaattggcttaacaagaaaagttgatttcttgtttgcagtatatattcactgcattttggtggggagctctgctccacatagtcactcagggaccccagttaatggagttccactatcctatagttctccatgtggcaactgtagcctccttagactttgattcactgtggcactggaagggagagagctgtgggattatgcaccaactcttaagtgctttggcaggaagcaacacatttgcttttgcttgcagcccataccaaaattacttatatgaccctgcattattgcaggaaaactgggaatgtagagggggatgcatacatattcagggagcatttatatttcttccatggattttctggctgttgagatgggaaatatccctcaaatacagcatcacttactctcataaataggaaaatatattaccataggaatatgtgtgttcacagtctctttccttctctgcagcactctgtgcctgccattctcattttgcatttgccatgcaaaatcaccatgatagttacagttgcaaagctgagactaaattgaataatggctaacatttattgagcactttctgtgtgccagatgccacattgaacactatctgatgcatacttgataactgtacagtctttctgtgtaggtattaatgtaatgacaatttaaatacaggctgcacagatacgatttgaaaagaggagaaatttaccattggtagagggttggatttatctggaaggtgaattgggcgggaagaaaagtcaagagaatgtgcgcttggattggagaaaaatgttgcaggaagggaacatcctcagggcaaattgcatgttgagaagttctgctgtccattaggaatgggaaggccctgtggaattttcttaaaagatcccagaaacatttaaatagctttttgattattgatagctatgtgactggcatttgttctagatgccaccccaaagagacaggtcttacaaggaagcaagaagctggggctttcgtggaattcacctattctcataagtctggttactctctgaataccaattttcctcatctgcaaaacagttaagagaactctcacagggtctttgtgaggatttaaaataatgaatccagagcatttaacccagtgcctggcacatcgttatgctcacaatccataccaggcatcaagctcaggctggagacacagggacagagtagacactgccacttcccttgagctgtttagtaacttagaagatgtagacacatgcccaactaattcacactcaaggctggctgtgctaaattctccactgagagagagatggacagggagagagagagtgagcacctggtgaagccaggacttagcgttctctccagcaaagggtgactgggggtggaagtgggcaggcaattcctgctgagtgaggattctttcctttggcacctcaagcactgcgcaaacattatctcccctttctgagcctcgtgtgtagaatggacagagtcataactactttgaaggtatttttgtgaagattaaatgagaatgaaatatggtgcttagtacaatctctggaatatggtagatattaggaatcttaatttctttctcattctcttatctttctctcttttctcctctttcccccttcttcttctgtatctatttcagaactcagcatcataccagagaaatacggaattaaaagataaaaacttatagtagaaaaacaattatttacatttatataatagctacaaatttctctctttttgactcttgcttcattatgttaaccaccctcttccatttactaagagtaaacattctaagatttatttatttttatttttatttttttgagaagagtttcgctcttgttgcccaggctggagtgcagtggtacgatgtcagctcactgcaacctccgcctcccaggttcaaatggttctcatgccttagactcccgagcagctgggattacaggtatgtgccatcatgcccggctaatttttgtattattagtagagacagggtttctccatgttggtcaggctggtctcgactcccgacctcagatgacctacctgcctcagcctcccaaattgctgggattacaggcatgagccaccgcgcttggccgacatgctaagatttattactcgaagactacaattcctactgatactgttcttggagaaaaatgcatttttacttctccctggttttttaattctttgtcattggccaagtcaactacatgtttggattaaggttgttagatttaacaagtaaaaaacacaggacaccatttgaatttgagataacagtgaataatatcttagtgtatctcatgcaatatttggaacatccatagtttggagagagttttataaaggaacacttcagactggctagacttcacctgacagtaaaactgagactatctggccttacgcttccctttgcaagtctggaccactctgggacagtctaggacagggagagagcctgggtttaaggtcagacagatcttacttgaatcttgagttggccattgtgatctgggctaacttacttaaccttcactcagtcaaaaagcatttgtggagctcatggcatagttgttacaagcacagaccctggagttggaggactgcctaggtttatttcctggctctgcagtgcaacttactaaacctctctgtgcctcacccaagactgtcctgaggattaaaatatgttacatttgtagactgtagcggacagtgtctggcatggagcaagtgctatataaatgtataacaaataagtgatagaattaaagtaatggcgaaaacctcaattacttctgcaccaacaatatagtgataataatgaaaataagaaaagatgttggtactccaatagtaagcaagacagataatgttcttcatatgatagagtgagtcctcaaagttatatctttaaaagactgaattagatatccaaaattttaccgtaaaattaagttgtcattatttcactacatttctcatgactattattggataattatttataaatctttgtttcttccgtgacacttgcagaaaagcaagtcatgtgatgacaggacaataataattatttattgaaggggatcaaaatatgccagccaaaatatactatcccctaataagcgactttgggcacatggattattttgagtggaaggccatcgagaatcaacagatgcaggaagaagccttcttggagcttctcctacctgactatgtgcagacacttctgagaaattctctctccctgggagagttttatggccaagaagaagacggaaagtgggtgctgagtgggcacacaaacctcacaaaaataaaccttagcatccattggtttccccatatatttccttcccacattatactgcctctagaagctcaaagctcttttcctttgtcttgtcacttctccacaaatcggtcaccttattgttaaagtgatatataagtccccaagtctgatggcccttttagggtatttttgtttgtttttgcttgtttgttttgagacgaagtctcgctctgtcgcccaggctggagtgcagtggcacgatctcggcatactgcaacctccgcctcctgggttcaagcaactctctgcctcagcctcccgagtagctgggattacaggtgcccaccaccatgccaggccaatttttgtatttttagtagaggcagggtttcaccatcttggccaggctggtcttgaactcagtcaaaaagcatttgtggagctcatggcatagttgttacaagcacagaccctggcgttggaggactgcctaggtttacttcctggtcttgatctaccggcctcggtctcccaaagtgcttggattgcaggcgtgagccactgtgcccagctccctttagggtttctatttcatttttgtgaggactcctataagcatatgaaaaaaaacatttttctcctgtaatctaacttttgttagtttaatttgcaggacctcataaactaaacctaagagagtacaggaaacaggggtttcatcccctagagtacaatgtattgatcctcccattttgagcacagtctgttatttcaacttctcaagcatcccatgggacaggcattgatctttgagttacagaagataaaggcccagggttctgacgtgcagcccccagctcccagtcacatgatttctaagcaggagaactgggatttgaaccatggtctctcagatactaaagtcccttgtccacagtgttctgttttactcacctgctttcaaaataccatcttggagtgccagtaaaaagcctgatattgaacacaaacagaatggccatttcaaagcattttgggaggtggaagggttagaaatccagtcacactcccgggagaagggctgagaagtgttgctatgactgatgggccaagaagtcacccaagagtcttgtgaaattaatttgcaatatgtctgtgtgttttgtcacagcagccctggagccgggagtgtggacggtgaaggcaaatgctccagagtcttaattaaacagtgtgttaccgccaatcaacaagggtcccaaatcaaccaaggttagttcagcttgatgagcaaacctgcctttctcactgaactctgcagccaaaaggtgctggatcagatatagcataattacagtgcgctgtggagaggtggaaatacacactggagtgtcagcgggtgtgggctagccacagtgagtgacacatgttctgaggcattacgacggtccgttcagccagtaaccttccatatagatatcagctctccctccttgaagagaaaccagaagcctggggattctagacagtttgcccaaggtcattaagctggcaggggcagccctggacttcaaacttaggtagtttggttccatgggctgtgagagaacaccaaaaggtgaggggctggcttttaaaaaatacctaatgacagaaaagaattgaagatcctaatatttgttgaccatctgatgtgctaggagttttacatatagtaacccattggtccttcaagcaacactactaatggcttgttataattcttattttatagctttaggaaaccaagcctcagacaaacataaggcccaagggaatgcatctgggagaaccaggattggaagtccagtctgtttgctgccaaaatccattgcaggttgaacactgagtaaggaaatataactttttagctgttgcctcactgccagccattttttagcgcactcttttatcctcattccaatgttttggaggctttggattaaagattatgtttcttttatcatagatgtgaggacaaaccatcctcccagctggtgactgccttaagattctaatcaatagcttaaaatgaacaacggcaagaaatagactgtgatcaagcgatcaagggatggagtcttagctaaatgcaatgtagatattggatgatagaaactgctctcatatctttcagtatccaggagcccagagctcaggattatagcagatgaattctttagctggcttcatgctttgaagaggaggaggaaccaaaagagttttaaaatacctaccatatactacttacctatcttctgagcaggataaattgacttcaaagaacttaaacagctagaaagattaacagctaggtcagagccatggggtttatatgagttcttagtgaaagatacagtgggtgggggtggggaaagtcttgataacattgctttaaatccccttgggaaaaaatggaataataatcctaccaaaaacttagtgtggtgaaagaagatcaactccaagggagaaaaatgcctgtgcaatgagctgaatagcatccgtgaacagaatgacaatgcactgattcagcatgggatgggaaaacctttctgacagtaattacgtgtattgaaggagtagaacaggagtccctaggtgatgagttctgtcttcctgttgcaaaggtttgtgggccaagcatcacctggcatgcaggcccgtgggagtcttctgaagaaagggctgggggctgtagttgatttcagcaggtgcctacagcgggatacttgtttttatacagcttgcaacctcaggatggttatatatttttaaaatgattgaaaaaaattaaagaagaatgatatttcataacatgtaaaaaccgtttgaaattcaaatttcagtgtccacaaataaaatgttattggaacattgccacactcattcatttatgtattgtctgtggctgtatttgggctacaacggcataactgagtagctgtgacagagaccatatggcctacaaagctagaatatttattactatctggccctttatagaaaaagtttgccaactcctggcctagaagaacttggccccttctgctcctagggcccacattcaacactgatggtttttatctagacactggagttgccatttgcttgtcaccttgctactactcatacttccctaaataagtctccattatatcagccatagtaatctttaaaagaaccttattaaggtataattcaccctttttaagtataaaattcaatgtaaatttagtgcaaccgtcactgcattctaatttgaaaacatttctattaccccagaaagattcttcctgcccatgtatggttaatccccattccctctacccacaccaggccaaggaaaccactaatctactttcaatctctgtatgcttttattttctgaacatttcctgtcactgaaatcatgcaatatatagtcagagaaatagttttaaaacatgaatcaagatcatgtcactacgttgcctaaaatccttccatagctttcgtcagcacctagaataatatcccaattctttaccctggctacaaagactcttgcagttgccctcttcctaagtctctagccatatcacatgcggccttttcccttgttcacagccacagcgactttgcactggctgctccttattggaagcctcttccccaggcttctcaacgactggctccttcctattcttcagttattctttctatttaaacaaaatcaaagccctcttgaccttacatctcctacagctcctccttcatttctctttcccttcatggcaaaactcctcaatgagttgtctctacttgatgccccagagcatctccatctcctctctctcaagcccactcccatcaggcatgacatcagcatccctccagtgcagctcttgtcaaggccatgctgattcttacatggctaactccacttctcactaggcactacagcacttgatgccattagccaatcactccctccttgagaccctctcagcacgtggcttccccacaccacagtctcctattttccctcctatttcattagctgctcctgctcagcctcctttgctcgttccttctcatttccttggcctcttgatgttgtagggcttagtctttgattgtcttctcttttctctctatacttgttcacttggggatctcattctgtctcatggttttaaatgttacctacaagtcgttgaatagatagatacaaagagtcaatcattgcttaatagtggagatacgttctgagaaatgtgtcattaggcaattttgtcatgcaaacatcaatagagtatgcttacacaaacctagatggtatagcctactacacgcctaggctatacggtgtagccgattgctgctaggctacaaacctgtacagacattactatactgaatactgtactcaactgtaatgcaatggtaagcatttgtgtatctaaacatagaaaaggtacaataaaaatacagtataaaagattaaaaaatggtacacctgtgtagaagaacacttcatcatgaaaggaacttacaggactagaagttgctctggatgtcagtgagtgagtggtgagtgaatgtgaaggcctcgaaattactgcacaggactgaagactttataaacactgtacacttaggctatgctaaatttattgaaaatattaaccttgctataagtagtaaacttagcttacggtagtttttttcctttataaacaaaatttttttaaaaccttttgactcttttgtaataacttagcttaaaacacaaacatattgcacggctgtacaaaaattttctttatatccttattttaaaagctttttcctgtttttaatttttcttttttactttttacttttcttttcttcttttaaacttttctgttaaaaactaggacacaaacaaacacattagcctaggtttacgcaagttcagtatcatccctatcactgtctttcacctccccaccttgtcttgctggaaggtcttcagggacaatcacacacatggagctgtcatctcctaggaaaacaatgcctttgtctagaatacctcctgaaagaccgctctaagactttatagtatttttttttttttttttgagacagagtctcgctccgtcacccaggctggagtgcagtggtgtgatctcggctcactgcaacttctgtgtcccaggttcaagcaattctcctgtctcagcctcccaagtagctgggactacaggcacctgccaccatgcctggttatttttttgtatttttagtagagacagggtttcaccttgttggtcaggctggtctcgaactcctgacctcaggtgatccaactgcctcatcctcccaaagtgctgggattacaggcatgagccaccatgcctggccagtaaattttttttataagtagaaggagtacactctaaaataagtattgtataataagtacataaaccagtagcatagtcattaattatcattatcaattattatgtactgtacataattgtatgtgctatatttgtatccaactgatagtgcagtaggtttgtttatgccaggatcaccataaatagatgagtaatgcactgtactgtgacactgggatggctacaatatcactaggcgataggaatttttcagctccagtataatcttaggggaccatcatcctatatgcggtcgcttgttgactgatacatcattatgcggtgcatgactgcataaatttgggtatggatatagatatagacagagatatcttcagccctgaacagtctccttaactccatacttaaatacctgctggatatttccaccaaatgtttcatatgcatttgaaatttaacgcataaaaaaccaaactcatgttctgcttgcaaaacctgactcttccccaatctaccctatctgcatgataccctccctcattatggtactcaaaaaactttgcaataatcctattctcctctcatatctcacatttactccatcagtaaattttgtcatctctgctcttaaaatgtatccagatttctaacatttctcacttcctccactgctctcacttgggtccaagcctctcttgactctcattgaaccaattactgcaaatgcagtattgctcctaactaatctcttgttctctgctcttgcctccttcagtgtattctcaatacagcagccagagaaactctttttaacataaatcagatcttgctatctctctactcaaagctttgcaatgacttccttcttgattcaaagtaaaaacaaataacctcataatggcccatgagggccttcatggcctgacccctgatacttctcaaatctcctctgtcattgctcttccttctgctaactcccttgccctgcactggcctgaggtagacctacccagaaccagaagataaactgctgggaatattttcatatctgatgtggggacaggacatgggacaattggacttttctcaggggagacaccttacatgtcttcagtgaggagaaatcactgggtccttggtcaactggatgcccatgctcattgttggaagctgaaattatcagaaacaagaacaagttcccagaatatctgggatgtaaggctatgaatgggcttttgctgcatttgtgcagatgaaggaaatttttaggctttttcactgtcatacagtcacctgaggcttgaagtgggtaagttttatttggacagaaatatgcagttgcagagtgggtacacttaccataaccacaaagttgtccatacgcctttgtgatgctagacatggactttgcagccagattgttgtgttctagaagagcagtctaccctggttctcagaggctacaggcaatgtttccacagtgaattgtgtccatgagtgtatcacttccagcttgcccagtgttagccatctttgtcctttgatttacagagtaaattgtggcaaccaggatgggtttttgtttatttttgtgtatgtctggttttcaagtaggcttatgtgccagatgctgatggtatcctgcaagtgtccttcctccctacttctgagttcacctgcagttcatagataattctcagcatgctggcagctctccaccttcattggcagtgcttctgtttctctatcagagacttttcttccccctgtttcatctctccactctctaagttgtgttttctgggaatgctttctgaataaaccacctacactcaacatctcatctctatttttgtggacgcccaaattaagacaacttgttgtgtgggcatgggatggagtcaaaagctatcactcactgaacattttctgtgtcctagatcctttgctaagtactctactgacatcattccagataatgacctttcaagataggtataattctccccattttacagatgcttaccataaaagggttaagtaaccctctcaaggttctttctctcacatgaagaaacattccttcccactgtactgacagtagagagaggaaaacttatataagctttactaatttcctctcccatcaactcacagtgtttttgattcacttattctttcttcagcccacgtggtctgagaagtgaagtttctccaaaggaagtaacctgagactcaggggtaggtggtcctggttaagttcaaattgtgactctttcccttattagtgtttgaccttgagcagatttctttatgtttccgagcctcaatttccccatgtataaaatgggaattacaatgacttaaaattttagtgactgaataacactttaattaggctgggcatggtagctcacgcctgtaatcccagcactttgggatgccgaggcaggtggatcactttgagaccagcctggccaacatggtgagaccccatctctactaaaaatacaaaaattagcctggtgtggttgcatgcacctgtaatcccagctacttgggaggctgaggcaggagaattgcttgaacccaggaggtggaggttgcagtgagccaaggttgcaccactgcactccagcctgggtgacagagtgagactccgtctcaaaaataaaataaaataaaaacattttaaaacactttaattaaacctgtgtagtggctggtaccaaggaggtgttcaattcccattgtgttgtctttgcggctatgggttttattttgtatttgattattttcttcccctgggtctttatgccatcgattacctattttctttcttttgtctttattctttccctctcaacccttcttttctcacattttataaatatactcaagcctcccctatcattccctcctgcaaccgataacaaactctctttacttgtcattgatttcgtcaacacttggaccttcatttttcctgcagctctttgcctttcttttaaaagagttcctcaactttacctatattacataaattcagtgggctctttcctatccatatcctgcgttacctcaacatcttggtattactctatatgatggccaccccctctcatttctcccccttttaattccatgaccctcttttcatttctatctacattgatcatggtttcttggacgctccttacattttcctcttcctctgcatacctttcaaggcagatctttcccaaagttcatgcttttccaagctttgcttttttatcacagagccccttgggtggtgagctcactcgtgccatgatttcatcctagttacttttctgtttcctaaagctatgtagcagtcttccttcctccctggctttctgttgggttcaggcaacagtagataccagtagaggatcagaagagggaaagagagtgaggttgcagtctttattcccttagctccctccctgctggttcactaccagattgctgtgtccaatgcccaaggtcatagtccctatcacatggccctctccataaagctccatctgggttctggcccttgtcgggctgttgctagctttgcaggactgtaccatgccaatttgatttaactaaactatgaccaaatctttgtaagcaaaccctttattaaaatctcctccacttacgtagtatgtgtatgactttcttatttctccacctggatcttaactgagacaaccacacattatataacccctggagaagcatgcaggaaaggaacttgagtgagaaaacttaggtaaattaaatgaatataaacatatttatcccctgcttagctagcaaggacttttattcaaaataaaagattctaatggattagtagctaagaataaatgctctggagtcagacttcctgctctgaatcctggctgtgccatttactagctatgtgaccctggacaaatgactaaattctctatagttcagtgtccctatctataaagtagggatgataatagttctgagtgccaagatttattgtgaagagtaaatgagatgattcacagagaatactaagtaaaatgtctggcacatgtaagtgctcagtaaatattagctattattcttatgtctcacagaactgagcttgggagaggctgataaagcctaggtccagagattaagcaatcacccttattagctggagggaggtttctgagctctaatatttgcttcatcagtccctaaagacaataccatgttcatgctaactttgagaatgccctagttacctagtgtggcagacaggttttaagatggtctcaattatatcttatgtagtaataccctccccttgagcataggcaaaatctgtgaattcccgttaatcaataaaatatggcaaaggtaatgggctgtcagttttatgatatgttacataagattgcaactttcatcttgccagcagactctcccttgctcattttgatgaagcaagctgctatgttgtgagctgacctatggagaaggctatgtgacaaggaactgagagcaatctctgcccaacagccagcaaaaaactgatgtcctcagtctaacaaccctcaaagaactaaattgttcctaatgtgagaacagaagtggattcttccccagttgagcctcagataagaccacagctccagccaacaccttggttgaatcttgtaagaccctaaagcagaggacccagttaagctgttcttggattcctggtcagcagaaactatgagataataaatttgtattgtttttaaccactaagtttgtggcaatatttgtgtagcaatagataacacacctaaaatgtagcgcatttactcattgtttcattctttagcacttacagtcaccatgatagtttctgaggacaaagattagatcgctatgttggccggtgctgcaagtccccaaaatgggaccatgggagggagtggaattgtagggagtggaagtaggagggtaggacatgagttcttgggcgatggcattagttaccaataaaaaaggcagtatgattctttctcctaatgagaggaactgagaccaggcagctgagagaaccttgtcagtctctagatacgagaggaatagtttctttgaaaggaaaagttcaaaattgaattctgagaaccatgatcaggatggaaggcagaagtcagaagggagggtgcagtttcagaccgtggatctgggaagagatttcctcactgcaccgtgatctccttaacttaaggacagaaagttccaaagagccctaatataccttcaaggcctcatctgcctggatcagtctccttcttgctttctgcattccaagcacactgccttcttactacatctggaatgctccctgtttacccagggcataaatcccactgagttgcttgccagaggcaatggagaccataagaacaagaatgtaaaaatgcaactttgctttgaacagaacttctaaactgagcctgtctcatgcctctttgcacatcctcttcccaatgtctggcaggcctgtcttctctacttccttcttcatttttggctttgtgaagtcatccttaaatattccattcatacctcatgctctgcatgaagcgttttctatacctctaatatgagccagtgccatgctttgtgtttccacagaacccttgattatctcattcatcacgcttctcacagaactgaaatgatcttaaggccaataccacattaaattgtaaaatactgcatctccgatgcttggtatatggtagatatccaattaatatttcttaaatacatgtttcttgaagtgaactgaatagaagaaaaaaaacaagaattctaatcaatacccaaatgtttaaggaaacagagttggcaaactggcctatgaagggattatacccaccaatggtccaattgataatagagaaatatttaggacatgttcttgtttgctgcatttgaaatgtgtaccactagtagataactcttgccaacactttatgctattaaactgctgccacatatatatttgtaactccaatgactcccaggggaactttgtggttcccttactttattccctgtgcaacaactacacttgggttagacgtagtcattactcaatactaacaaggagatctacaggatcaatcatagtattcttgtggtgagcaaagaaatatattcaacacatttcctcatgctgggcattcatgaagactacatttcccagcctcccttgcagattgccccataccatgtgactgagtttaagcaatgagtctgtgagtgggaatgatgagtcactttgagtccaaggcaggaagatgtgggtatggcttttctagagcctctcctcctggcaatctggctagaagtgaaggactccagctcttcagtagcccaaatccttgcatcactctttgaaactcagacaatctacactggactgtgatttgagcaagaaataaatctttgttgcattaggccgttgatatttagagcttttccgttagcaacagtcagtgttgtttatgataaataatacaatctcataaaagttgttctgaagcaaataacattcctccacataatcactgaaatgtctatttattaataagtggtgcagtatttatttaagatagaacataaaaaatcaggtaagaattatttgcataatatatatggaaatcaacctattaaagttgttcaaatattggacagagccagaatataaattacacatacagtttaaaaattacaggaaatcatattataaagagcactaaaggccacttgtggaatagttgtgttcccctgtaagccagaatgtgaagaaagcctactcgtagcacagagacaaacccagggagcaaggcaccagaattctatgccataaaaaggggttaaaaaatacaatccaaaatcaaatataatggattcatgtcactgggaacctccatttgttcttcaaagactggtgttttccatcactgctacattagaaaaagaaggaaaaaaaatagccatatcctatctgaagcaaggcagagatcatttttctctttaaaacaaggaaggactgacaaatctgatgaagtccacctatctttctaagttgatttttcaggatggcacagagccgacttcacctctccaacagcaaatctctgatccttggcaaaatggctgccccaaatcttgcaacttggccaccacctggactcttaaccctcaggggaactatgggggtgggaactgccccctccttggaaaagtattcagaggggtatagaagggcccaattaccagatcaggttggcttccatgggaaaccttgatcttttaatactgagaaagagagacacaactgttctgagcttttggcctcccacagaatgtttttatagactcacctgtttctgcagaatttcagagctcagaaataaaggtacagtctagagacaaaagaccagagtcagcagagacgtggagatatttgaacttgtttggttaaaaacaatgacaggagctccttgggggcagagaacaaggggcacttgtggatgatctgcagccacaccaagccccgagagctaatggattccaatgtgaaccaggtgaataatttatgaggcattattttctgccactgacagctggattgtgaagccactcaaaggacctgctgaacagacaagaggaacagctgacccaggcatcactctactctccagggaactcatgggtctgtgatcattttactgtaaagctgagtgaacgtagaagcccgaagcattgtggaggagctagggcctgatttgagaggaagaagggggagagagaatgagctttccaggtacacgggctttggttgaatatgcagctctacttcttacaatgtgtgacctttgacaaggtcttgtcttcagtttcctcatctataagatggagacaataacatctccctcatggggttgcgatgaggattgcatgaactttagagagagctatcatgtcacaagcaactcataaggagtgcttaggataagtttctctccccttccctgacctcacttttgtgggcagaggaagagaagggaacattaacataaaatatggtctcattttttattactcttaggtatcaaattgcagtccattcgacaagtctaagaggaattacaaatacattcctgagcactgagctgggcttttgactacctcattgtaagccattctcaagttattcttatatacagccgatttttggcggtgtcaaagaaattcattatttcccttgaagcttattttaagcccataacagtgctatctggaggatgaaggcttaggtagaatgacaatctttaaaattactgggccaactattgttgttctagaacttgaccatccttctttctgaatatctcttaggagctttcacttcagcctgactcaggagaactgaaacatcctaccacagggattcacaaggactgctggggagccctgccaaattctggccgatttatcccgagaacaatgtaagtggaaactaacaatgaagatgttcatttgagccaacagaggcctgtttacttcctaaaataatctcttagttacataaccataagatgtcctaagttgagtcctgtctgcttctttgtagcttttggtgaaggccctagagtatctgcttatgtcctgacaacatggggattctctgggacaaggcaagaggacccaagctgtgttcaaatgagacccagagatcccagtgcaaagggacacctttggtaaaactggccactttgggtcatatagatcccaaaagaaatcatgcctgacttcctaaaatcaaaaccatagggatttatcaagaagaaaccctgtttaattggcctatagatgaggatgcaacctaaggcatgactgttgctgaatgagcccaagtgatgggccaaaaaggtgaaccagtccaaacatggcaggaccaagaaggaacaaggtaggagagggcagaggggtggagggcagagaggtggaggggaggagtgcctgcatggccatgggattgttcttcattccctttctcaactgcacccagcagcagtggtttttgctaggccttttgaagacagcaggaatctgggagaaggaacatcatcgtctttcacagcatggaaacatcaatcttattccagagaagggaagaagtccccaaaggtatgtccggtttaacagtttctcaagtgggccaggaagttctttttcatgttctgggctcaatcgtgatgctttgatttcacttggtattttacttttagttttgtctctaacatctggagcaaagatcagaagacctgagttccagatttattctgtgactcaatcactgcttcaatcactgagggacgtggtgtgatgttctttgctctgagcttctgcttcttgatctaaaaagacaggtggttgttctgggtgatcaaaatctcttcttgctctgtgtatcttagaatccatgaaattatgtctctttgcatctatgataacaaatcaaaatatgaatcacaattttcttacagggttgctgaggttaaagccgtgaaagcctgggaacaaatctccccagggaaggtttaagcaagcattaactctttcttctgcaagttcccccattcattgctagggtgttgtctgatagccaccatgcacagttgactttccttgggaaatcatgagtcttttatttttgcaatttggctttatctcctacacatcatccagatggtgcaacatctggtactatatgtccaatggaattgccacaactcagccactgagatccaacattcctgcctctcttcattccaagattccttctgttctttattgtggtagacaagagcaagcatttttatttgcagagatgtacttatttaaaaagcaattgtgaaagcatttgatttaataattaggattgtttctccacgattctttttctgaaaaaaaatttttttggtgtaaatttagagtttataagtaacaccaaagactgagacaatgaagtccatgcatactgtaaaaaaataacataaataacagtccctagtatgcatcagtcattgtactagaggctttgtgtgtacattgattgtctcacttgaaaatcaaaacacggcagaagagtcaaatgcttttgaatgtgctgaaactcaaattttcttccaggtcatctctgtatgattcctcttttacactgccattactggcttctaaaaccactaaagctatgcagatagcctggtcctaacatgttctaaactgggcattagtgaggggctgcctgctggcttgtttaggggccagttggctcagtttggaatggtttaatatcagcaacaatagcattgggttgatttgaatataaacaacttagactttaaaagttcatcctgaaaaacaagccttcaaggacaagtgaggacatgaagcaaattcctaaggatgcctggggttcaggaagcaaagaagaatctttggttattcatgaaaaccaaataccagctatgtggcatcttctgggaaagcacaggggtgggagaatcctggggtgtgtttggcagcactgtccaaagtacagttgacttcttaggctgctgaacaaatttcttctcttgccccaggagaatttgatctgcaggttcccataagtagagtaacatctttctcttgaaataggtgctgtgtcatagtctgtatcataagcttctcttggtcaacataatgaaatgaaagtaactcagctccttgactggtatcaatcttagcagggattaggagacaagaagaaagctggtttctccaacaatcttcctcagattccctagaatcccccctttttgcacagcttctctggagctatgaagttcaaagcattgaatccaaactcgaagtccccattcaacccactcagccttgactgggctgattggatcattgccattttgatgtagaacctttgctctcattttcatgttcaattttctatagtttccaagctaggaagcatttctgtctgtatagagttgtttgcagggatgaaatcaggtattttattttcctggtagacatagtttgaagggacctctgatgtttgagacctctagattcctagcattttgatggcagaaactgtggttttcttatctctgaacttccagtgcactgcaaagttctgggcatatattggtgcttaataaaccctgttaaatgaataaacaaatgattttttctttattacacccccatttcagtagcatggaattatgaggatgattttgccaaattatgagtaggtcctattagattaggtttttctacaggaaattattctttcaaactacagtgtctaggaagtaccttgcacaaaatagacacaggatgcataattgttgattaattagttcattttaacctatacaccttggggttatctagttatgttttcatgaaaactagggctttgtaatatcaatgtcatgtctaataagcctaaatttccagttctaaaaacaaagttattcaacaacactttctcaatttgatgtgtttttcttttcctgaaataatttttttcttaagcttttgatatttgcttttgtgctgacatttgatagtcaaaactcaaacgatctcaagtacttctttctcagctcaataggatcatgtttcgcttaacatttgtgaagttgatttatctaattcattttgatcttgctaaaatatgacctttaaaatttttcatgtcacattgtgacccagaaagaccaaatacatacatgagatcatagttttacctgataatatcactcctagtttgatgatggaattaatttgtcaatatttcatggagttctgctgaaacgattgcaatttcttgggcaagtttcagaacgactagtatatctgtggtcatgtcatcttgggtcatgttaaccagttccattggattatcatgctgttcccttgtctgacaaaaggatctttgtgaaagcacacactgtttcttcccataactcacattcaattccagaccctgaatttctgcttgctcactgtgagccatattgttgagattgtctgtgcataggcaacttgagcaggtttggtttgcctttctggaatatattttttggggaacaaaaggagaatatcaaagcagagttattccagaagatcatttttctcttttcctttttgttttcttaaatgggaaaaaaacagctcttaaggttcttattatttattcattcataaaacatgtattttgtctatgtctatactgataaagacaacttactagatgttagacaatcaatacttccctactactgatcaatacaaacccaatctctgctgtcctggtcttatgatccagcagggaagctagactgcctgcctatggtttaggaaataatacaagctccaatcctttctaggttattaaaagaatctaaggtagttcctccaattttggatcaatggtaaatactttaaggtagaactccattgagttgctggaaaatgcatcatctattggtaaaatacttaagatagtaagttcttcaagaatactaataagtaagttaaaaaattaattggcgcatatgtggagagtatgactcactctcctttattgttggtttccagtaactcatgtacataaagaagagcatagtaacatgttggatgttaggcaggtgatcatctcaagtgaaagattccaggaagatcaggattcaataatcaagccctcaggaaggggcatagggtttcttaggttgtaatccccactggcactttcagccatattgaaggagtggggaaaaggcccaaataacccatgccctttgtccttcagattgccagcatgtcaaatggaagcccgtggggcttcatgtctgatgcattgagcattctggtatatttcccatctcagacttcaaggtctacacccatccatttatggggctctccataaaaaacacccttctgctgctcacaatgtctgcccttggcctgggactttgggctttggttctaagttcctaaagtcaggggtcaagctctaatcattactgtattctgagctttttgtacagtaactgttgacatgtgagttgaaaggaacctatctctgaggaagtgattcctctctccaacatagtgccagactctcgtattaggaaatgatgaaaccatcaaccaaatgtctgccatagctactgtggctcttgacaagactgtgagggagaatagcagtgtcagctgcatacagacatttgtttaggtcatctggattatcttgattgtcaccatggcaactatccacaaccagtgcctaggtgtgtgagaagagtgatacaataatactgtggcatggtcatttagctaattcagtctaagcctaacagaaaccttttccatcaaagtttttcagagaataacaacatctcataagaggccagaggatggcttgtgcttaatatcacacctgtacagtagggcagtgcttcccaggctgtctgcttacattttagcttgtcttacggttacatatggttttagtattttcatttaaaaaatctgggttggttccataaatttggaaaagtaaaattggacggttctggaaattttgcctgtttacacatctgtaaatgtagcttgcttgcattatttttttctagatctgaaatgcattgcatcaagcaagcatgttttgcaataaaagtggaaatccccctcctgctggataaactgggtgctttccacgcgacacaaagtcatatatcttgacacaatctctaggatgcattatataaatggaagaatggtgtggtgaggggaaacaaggtcagggagagtgggcagacctgacttttgagtcctggttctctatgggacaactgagtgactctgggtatgtcactttacctgagcctaagattcttcatttataaaaggaagtccttggactagaaaatttctgtgtgccttcttgactttaatttctattttagatggatattttgtacttcagtatcatgggaagaaatgagagttggaaattcattttaaaggcactgaactcagctcctgcccagaggggcacttcacttctgataaattccattgtccttggctacataaattggaaactattttaactttgtgtatgtgtgtgtgtgtgtgtgtgtgtgtgtgtgtgtgtgtgttttctccctgccaattcataactcatcagaaatgctacacttgggattaccaccactttttacagataaggaaactgaggcatgatactaagtaacatcaggccaagtgaggtcttttggagagcttttaaaaggttttgccttaaatatttgtttaaattctttgttttagagacacaatgactatctcattcctttcctaatgttagctcagtaggcagccccactgatacacaatgtggttttgttgagaaaattatttccttgctttcaaaaacagttaattgctggagcgttttacacaagagggcagtgatcctagaaataacttaaactactttctctgcttaccaaaccaaaacccaaaccagccaaccaaacagacaaatagcatggctcatcagtaatttctccctgtactggtccaatcgtgattaaaagtaagaacagcagataaatgtgtatcctagaagagattagcggaaccatttatatagtgtaaagtcatgcaaaccatgctgaaaaggaagcactttgttgtggtgacatggggaggaagaggctgtgggaagcccctgcctgggtggggccaccacgcacacgcatgcatttgatgcagccattggtgtccccgctggtaagcgtcgggtgtaagagtaagtgaactatacaaagtctgtctacattacaaggaggggtcagccagtgacctcttttaaatgggcttattggaaggggtccatactgaatcagaaatcccatcccctgtggacgacagaggcatggagccgctgggcgtgaaggggtccgtgtctgtgtccgtctcaccctcggcgaggtaccgcttctccctcatccagctcgaccccccattggggccgaacacataatcatctctgtcctgggagatgctgaagccacttggagacctctccagctcctcgtggttgaccgacatcagggacagaggtgtgtcactgtctcgcgtgatgctacgtctctgccggggggagattcggtccgagtaggggccctgcaggtcagcctgggagtggcagctcactcgggagtcgagaagagtcaagataggcaggaccgtgggcctctccacatacgttgttgctgaggaaggaggagttgcctgaacctttccagaactgggtccccctcggggcaggttcacagggtcatgtgcaaaaaacccataggggctgactttgtcaatggtcacctggtggaagctgtagggtggttccggggggcctgtctcagaatagttgcagatgatggttttcaaatcggaatacctgttgtcctccttcttctctgcttcagctggcgaggaggtgcccttggttgggtaatactccgtgacctgcacctgcaaccgttccatgtgttgcatgtgcatatccacgaggaagtccagcttcttccccatgtcctgaacctggaaaatcaaaggagctgtgaattaccactttctctgagggtggggatcgttgctattggttgggaggaaatattctttttttttgttttttttttttttttgagacgaagtctcagtctgtcacccaggctggagtgcagtggcgcgatctgggctcattgcaacttccgcctcccgggttcaagcagttctatgcctcagcctcccaagtagctgggattacaggcacccgccaccatgccaggctaatgtttgtattattagtagagacggggtttcacaatcttggccaggctggtcttgaactgacctcgtgatccacctgccttggcctcccaaaatgctgggattacaggcatgaaccaccgcgcctgaccggaaggaaatattctaatactgtatttacttttcagaagggaagataattcttgcaactcttaataatagaaacagctaataatttattttgtgcctcctacttgcaagccttgcacaccaggtattaatgttaatctagagaaaacctaggcaaggtcttctaggaagcaaaggcggaaagcagagagatgctttgaagtgttacaggcctgctgtgtcccctagaggaggaagtggccttgctaatgttgcccgggtcaaggagcaagagttctcaatttaggaacatttccttagacagaagcatgtggactgttagtctatgtttcttctacatggtgatttaagccctaaaaatacaagggcagtggttagcaagaactgagcttctcagaactgaagaccctacctagcagcttgctcttgcctgcctaaattggcaccttacttgaacttttgtgaatgaatatacatgagtgtatgtgcacacgtgtgtgatgttcttgctttgacaattcacaactcaccaggaaacactgtcgtcaggtgtatcaccctattttacaggtgaggatatgagcaccatgatcagcagatgccaggatagcatctgagcctcaataataactgacaagggtcagttagaaaagttacaatctgactctgtcttatgcactttattgacttttgtgaattttatgacaatcccccaagatggatactattattatctctatttcacaggcaagagaacagacactgagaaatagagtggaaattataaattaaaatttaaaatgaaaacaaaattcttgatacaacaaaaaggaataattcagatttgcttctacctctcctgcacgggtcccatttagggttttgaataaaacaaaaggattactatgatccttgaaaaactggcagtaccatttatctaatgtagagttaggcagatgatgctagattatgagctgtttgctgtgaaagcaagagtgagctgcatggtgctgtgagtgagcgggtttctctttccaccttgaatggatctcacctgtgcctgccctccttccggcctcttcacgcaggcaacccactgcctggacattgagaaaaggaggacacacaacatgcagtggcaggtcactagcatttcctaagggttcaccatgaaatgcttgataattgtagctattatcaagtgtccactgtgcccgctaatattatgtatcaactcagtcctcacagcaacctaatagggtattataatccccatactacagatgaggaaaactgaggctcagaacaattaattaacttgcacgtgatcactcagtaaatgctgaatcagtgatttgatttccatatcttttttgaatggtaggtagtagtactcaagtatcttatctccctttgaaaaacaatggtggggactgggcgcagtggctcatgtctgtaatcccagcactttggtaggccgagttgggcagatcacctgaggtcaggagttcgagaccagcctggccaacatggtgaaaccccatctctactaaaaatacaaaaattagctgggcatgatggcaggcgcctgtaatctcagctcctcaggaggctgaggcaggagaatcacttgaacctgggaggcagaggttgcagtgagtcaagatcgcgccattgcactccagcctgggcaacagagtgaaccttcgtcttaaaaaaaaaaaagaaagaaagaaaaaaaagaaatggcatttgaaaataaatgtcacagatccagtttttggtgagaggaagaaaagacttacctgtctttcaacttttacaaacttccccatcatgctttggtcttcgatttctgatgtggatggtctggctacatatggttcattcctaagaagaagcgaacacttctataagatcattatatctatttttgctatgcaaggtaatttcggctaggcaggccatggccaacagagccatcgttctcaccctcacacttgtgtggcataaaagagcaccaatcaactctggaggcatatgtgagtcaggaaaagtcagagtttttctgcattcaacactggtatctcatgtttacctccactgtaggaaaatttgaagccaaatatcaagctgctattaaggaggctttgctttgtgttaaacattataaagcacctaacagtacctagagtatctagttcctttaaattaaattccttagcctttcattcttagatttgagatctgagacttttactctgagtgtgtgtgtgcaggtggagaaggggtcatctaatgtctgaaattacttacagtgggtataaatatttcatctggccaattttaataagaatgaagaatcccaaatcttgaacatgatgcaaaagatgacactggtgaggaatggaattgaaatgtgtgctgaatttgatttttggttatccactgttaatatctgcttaattctggttagtttcaacatttttattttttttgcagatagaactttcagggagtctagctatttgctagaaaccattcatgctaggcactttctcaatagttgatttctctctctcataggctgctgaatcctgcttagtaggatagtctttggctgcgaagccctaaattttaaaaagatgtcagaaactggtggtccatgtgctaaatccagctggctagtgttttctttggcctgcacggggttttaaaacatgtaagccatctcaaaaattgagaatttcatgtaaaagctggatattctgttttctggaaacagaggatctgcatccctaaaagaaggtagggcgctcatttctaaaagaaggtagagacttcattcctacctcttttagatggggcacgcattctccaggtgcccacggtcccatcactccctattctatccccaggactgaggttaaatattaaaatattaagttgctttctatcatcacgttaatgctctcgattcttttttttttttttttttttgagatggagtctcactcttttgccaggctggaatgcagtggcatgatctcggctcactgcaacctctgactccctggttcaagcgattctcctgcctcagcctcccaagtagctgggactacaggcaggcgccaccacgcccagctaatttttgtatttttagtagagatggggtttcactatgttggccaggctggtctcgagctcctgacctcatgatccacccgcctcagcctcctgaagggctgggattacaggcgtaagccaccatgcccggcctcttgattcttttataagtggaaggttcataatatttcttaagcctaactccctcactcattgtgttacctgccttgaagacatttgggaataaagagatgtaaatttaggcagtggactttctaaagaacatcttattcaaaattttgaagctttggaaggagaagagctgctctgttaagggacaaagctctctgtgttacaatgttgtcagggggctgatatctgagtgtcttctctggctttgtcctgggaggggtatcaatcaactcaaaggtaattatgcaggatggagaatgctctgggttctgctgatatgaagttttcttcctgtttcaataaagctcataagtctcctcttgttttgtaacagtgtgaaacaggtggggctattatcactttcaaaagttacaggaagaaatgtcatccacatggtctgggaagaggagtgagaacatttttgtacagaaacctttcaaatggccaccaactgaaacaagcttcaaactctttcttcattttacttaggagagtgacaacttcacccacataaaggaccccagcagaggtttgggggtggggatgctttacaaactttgcacccctggcccatcagtccatgtccactggccccacctgggagattgctgggatgggaaggtgaatgctgaccctttctgagacttcttgtgttttggcgtggagggaggtccaggggtgaaaatcatatctattctgaaagaaacaaacagagcagggattaaattacacagagctttgttttgacaggaaaacaaatcattctattctctctagaatgagataagggtttggaatatataagaggagaggagaggagaggagaagtgaggagaggagaggggaggagaggagaagtgaggagaggagaggggaggagaggagaggaaagagagagtgcatactagctacagagagaaagacagagccagagagaacctataacctcggtatattcttccgcttgttttgatctggtgatactgaaagcatctttctatcccaggagagagggaggcagacaaaccactgagagaggtgacggctgcatcttgttattttttttttttcataggaaatgtcataggtggactgcaaacctgtcttttcttccaattcttctatcccttccaaaaacatctagttagggagctttacagacaaatcctaggctacatattcagctgcacacatcactgctgctctgtgggcatctctggccagtagaaagatagatccaacaccagcttccattcctatttctatttctgcatgaggcaccagctcctttttaaataacttttattttaggtttgggggtacaggtgaaagtttgttacataggtaaacatgtgtcatgggggttatcttttctgctactctccctcctaccaccttaccccagaacctgttgtttccttctttgtgttcataagttcctaacatttagctaccacctgtaagtgagaacacgctgtatatggttttctgttcctgcattagtttgctaaggataatagcctccagctccaaccatgttcctgcaaaagatatgatcttgttcttttttatggctgcgtattactctgtgagtcattggttcctgctctatgcctggaccaataggaaagaaatgttgcctatcacgctgtaggttgggacggggtgggagggaaagcaggcttgaaggcttatcacaggtccaggaccattaagactatgcaccctgaaacagtcatggctccttccgtctcctccttggaaacccagctgctcctccactgacggcactttctttctctcttgccccgcaaggtcagcatggctggggatatgcaatcagaggtccagatgttcaccctccagccacaaatgctagaaacacatttgcttagtaagtagcaaaaactatgccactgtcatagtccactctatgcttattaaaattggctggtatttttggagtctggcatgccttagacatcatgcttcatcctcgtctctcggagagccatacttgcataaataacagcatgttaagctcaaaatttgttcacacatctattcattcggcaggcagtgagcactgactctgtgcctgccactatactaggaagtcaaagttgatattccagttagggataaagaaaggcctgctgggtgcagtggctgacgcctgtaataccagcagtttgggaggctgaatcacctgaggtcagaagttcgagatcagcctggccagcacggtgaaaccccatctctactaaaaataaaaaattagccgggtatggtggcacacgcctctagtcccagctacttgggaagttgaggcaggagaatcacttgaacccgggaggcagaggttgcagtgagccgagatcgcgccactgcactccagcctgggtgacagagtgagactccatctcaaaaaaaaaaaaaaaaaaaaaaaaaaaagaaaagagaaaggccatggagaattacacctccaagctgacagatagcatcattaacttccaacccagtcagtgtgatgttcctgttctctagcaggacactccagtgggacaacatcactcggacagggaagctgaggcccagag

SEQ ID NO: 435 - DNA, 48972 bp, Homo sapiens
gctattactagatttataaactttatcaaatcactctcctactctatcccttaattcaacatatttaaaattggaataaaaatctcaatgtggtagagttattattgagatgaaaatcagaatagatacaaagaacttgatagccccaaggagcttgatcagtgtttgtttaatggcccttcctctcttctcatatctcagttcagatcctactcagccatttattttattctgctccttttggagtagagaataaagccaagaattatgcttaaaaagtagcataattaaaagtatttaaaacacaagtaacttgagaaaggtgagttggaagtttatatctaacctcagttttttttggagagaaatttacccgtcagggccagattaaaacatttacaagtcccaagcacacgtgagatgaagatgcccctcacttatctcacatgtaagttgaaagttaaaaagtgaaaatgtctactagagttcaataatattctttttttcccatgacttctctgaagcttttagaaaatatgaaattcttaaaaacaataacagtaacccacatttttattgccctggtttgccctatcttatctttctcctgctcacagggtctgaggcagctgggataggggagaatgattaccagccaatcaatattttttgaaccccagagattatttatttatctatccatttatttattttgagatcttattttatctggaatcttaataaacgattagtttccaaactgtatctactgtgtgtattttatccatatggcccagatttgtattacttatttgtgattctgaataatattttttccaacattaattatcagcctctctgtgcccctccagaattgttacaacctatgttaatgcacactatggcaagccatgtgaattgcctacgcagggaagttttcttcatacttccttgccaagagaaccccattattggtcagttactagtcacatgatcttctttagcccctccttagcccctgtagtgaatcaggagtagcctaaggccatggtggtaactcccctttttcttggaaatgtttgatttagatatggagaagaggtgcaactttgcttatgaaatgggagggcaaatatgggaaactttaaggtaagttttctttccccttgaaggggaccaaaaagttgtggtttatactttcttgactctggtcactgttgggtgaagagttggtgctatggaagccatcttcagaccatgaggggacaagtctgaggatacaattacatgctaccggtggcagaggacagtatagcaagaaactggatccctgatgacattgaaccattgactgaatctaccctggaaccatcaggaaataatccttagttttttaaagatgcttttagttgtgttttttattacaagtacctgaaagcatcctaactaatcaatgctaaatgcatctctcacagtttatgcttatttttcagaaatgcctagtggaaatttctattgctgattataatatttgtcctaaataaattgaatagactgtcaatcttttgaaaataaaagcatgacttgattagcaattgtttagtctgatgttttcctaatttctgtcatttgcataccacttctttgattttgtcatatccttgtatcatctgcactaatagaaatatttttccttaagttgtctctcctttaaaaaattatatccatttattttgaagagaaactttttcactaactataaattgaaaaccgatatcatttgccttaaatagaagattgtcataaaaagaaatgccatgagtgaaataatgttattaaatatttgccagatatagtttcctatgaagactctgagcttgtggcttgctgtctctgttgaaaggagagactagggagtgttatagaagtggtaaaataatccttccactgactgagactatttccttgccacaatcagaagaactaaaagaaaggaggatatctgttaatatatgaatttatctaaatgtcatgcagtgacttctaaaatcatctggtgtgctctgtttccccttggaggtgacttaggcctggcatcccaaacaatacatactggagtgaagctccaggaaaccctgaggagaagagaagggcttaaagagcaatcagccttcgattgctgggattatgaaaggtcgtaagaagcgaatgttgcaatgttttattatacttgatattgaagcaaggacaagtaataatttattattctctccatgtcagtggtatttacctttttggaatcatgtgccccattgagaatttctggaaaaccatggttcttctactcaggagaatgcacaattgcacacatacacaaatgtgcaagcacacacacacacacacacacacacagaattgccacagaaggtcagtaggttcacaggccctaggctaagaaccagcattctgtatattttacatgtgttctcttacaagttaccgtgtgattcagttcactccaaactgcggttaagtgcaaaacatggttttgaatatttctatcaattagtaagagtggtatgttaatttaaatacaccaaagtggagaattactgtcctctcaatagctactttaaatagacataagttacagtgatattgccttccaggaggcttcaagaaatgagatcaggctctataaaagaaaatcacccaaccctataaagtcatctttatgaactttgaaacaccactgtatgtacctagtaaaaattattcctgggtaagcagactcccaggcctgggtggagttcacatgagtccctttgctaaaataaacagaagtgactgggaactttggattgcctttgtctgaacttgagtgtctggatggatcagcatcagcagcataccacacacctgcttgtccagccaaagagaaacccaaagacttggcatttgttttttacattgtcaactgtgcaaaaatatcacgattctaatttatgagggtccatgagttttaaaaacaccccctgacatttttctagccaaataatttttcctttaaaaggcacaggatgagcaacaagattaggtagatcacttcaatctctaatttcaaaagataatagttaaaaattcaactgtaggactaacacattaactatgtaataagacccagaatagtctttggagcaaatttcagtggatacttgatcaaaataatgttgaagacaaaatcttgaattgatgatatttatctgatacaattatttacataacaaatgttaaaagaattagaaaaatttcataggtaagatgttcattatcttcaagtgaagttacttgctttatattaagaaccacaaaaacttactaaacttttttttttaaaagggtctcactctgtcacccaggctggaccggagtggctcaatcacagctcactgcagccttgatctacccagattcaagtgatcttcccacctctgcctcccaagtaactgggactataggcacatgccaccatgcctggctaatatctctcttttctttttttttccccttattttgtagggacaagttttctccatgttgctgaggctggtcttgaactcctgggctcaagtgatcctcctacctcagcctcccaaagtgctggagttataggcatgagctactttgccccctagcagacgtcttacttttttttttaatttggtattagattgagccaatgactaatttcaaacatttataaattactaaattcttttttttaattatactttacgttttagggtacatgtgcacaacgtgcaggtttgttacctatgtatacatgtgccatgttggtgtgctgcacccagtaactcgtcatttaatattaggtatatctcctaatgctatccctcccccctccccccaccccacaacaggccccggtgtgtgatgttccccttcctgtgtccatttgttctcattgttcaattcccacctatgagtgagaacatgcagtgtttggttttttgtccttgtgataatttgctgagaatgatggtttccagcttcatccatgtccccacaaaggacatgaactcatccttttttatggctgcatagtattccatggtgtatatgtgccacattttcttaatccactctatcattgttggacatttgggttggttccaagtctttgctattgtcaatagtgccacaataaacatacgtgtgcatgtgtctttatagcagcatgatttataatcctttgggtatagacccagtaatgggatggctgggtcaaatggtatttctagttctagatccctgaggaatcgacacactgacttccacaacggttgaactagtttacagtcccaccagcagtgtaaaagtgttcctatttctccacatcctctccagcacctgttgtttcttgactttttaatgatcgccattctgactggtgtcagatggtatctcattgtggttttgatttgcatttctctgatgcccagtgatgatgagcaatttttcatgtgtcttttggctgcataaatgtcttcttttgagaagtgtctgttcatatccttcacccactttttgatggggctgtttttttttcttgtaaatttgtttgagttcattgtagattctggatattagccctttgttggatgagtagattgcaaatattttctcccattctgtaggttggctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtataaggaaaggatccagtttcagctttctacatatggctagccagttttcccagcaccatctattaaatagggaatcctttccccattgcttgtttttatcaggtttgtcaaagatcagattgttgtagatatgtggcattatttctgagcgctttgttctgttccattggtctatatctctgttttggtaccagtaccatgctgttttggttactgtagtcttgtagtatagtttgaagtcaggtagcgtgatgcctccagctttgttcttttggcttaggattgacttggcaatgcaggctcttttttggttccatatgaactttaaagtagttttttccagttctgtgaagaaagtcattggtagcttgatggggattgcattgaatctataaattactttgggcagtatggccattttcatgttattgattcttcctacccatgagcatggaatgttcttccatttgtttgtatcctcttttatttcattgagcagtggtttgtagttctccttgaagaggtccttcacatcccttgcaagttggattcctaggtattttattctctttgaaggaattgtgaatgggagttcactcatgatttggctctctgtctgttattggtgtataagaatgcttgtgattttcgcacattgattttttatcctgagactttgctgaagttgcttatcagcttgaggagattttggctgagacgatggggttttctagatatacaatcatgtcatctgcaaacagggacaatttgacttcctcttttcctaattgaatactatttatttccttctcctgcctgattgccgtggccagaacttccaacactatgttgaataggagtggtgagagagggcatccctgtcttgtgccagttttcaaagggaatgcttccaggttttgcccattcagtatgatattggctgtggttttgttatagatagctcttattattttgagatacatcccatcaatacctaatttattgagagtttttagcatgaaggttgttgaattttgtcaaaggccttttctgcatccgttgagattatcatatggtttttgtcgttggttctgtttatatgctggattatgtttattgatttgcgtatgttgaacaagccttgcatcccagggatgaagcccacttgatcatggtggataagccttttggtgtgctactggattcagtttgccagtattttattgaagatttttgcatcgatgttcgtcagggatattggtctaaaattctcttttttttgttgtgtctctgccaggctttggtatcaggatgattctggcctcataaaatgagttggggagaattccctctttttctattgaatggaatagtttcagaaggaatggtaccagctcctctttgtacctctggtagaattcggctgtgaatccatctggtcctggactttttttggttggtaagctattaattattgcctcaattttagagcctgttattgctttattcagagattcaacttcttcatggtttagtcttgagaggatgtatgtgtcgaggaatttatccatttcttctagattttctagtttatttgcatagaggtgtttatagtattctctgatggtagtttgtatttctgtgggattggtggtgatatccccttttaattttttattgtgtctatttgattcttctctcttttcttctttattaatcttgctagtggtctatcaattttgttgatcttttcaaaaaaccagctcctggattcattgatttttttggagggttttttgtgtctctatttccttcagttctgctctgatcttagttgtttcttgccttctgctagcttttgaatctgtttgctcttgcttctatagttcttttaattgtgatgttagggtgtcaattttagatctttgctcctttctcttgtgggcatttagtgctataaatttccctctacacactgctttgaatgtgtcccagagattctggtatgttgtgtctttgttgtctttggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgatttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatgagatgggattcctgaatacagcacactgatgggtcttgactctttatccaatttgccagtctgtgtcttttaattggagcatttagcccatttacatttaaggttaatatgttatgtgtgaatttgatcctgtcattatgatgttagctggttattttgctcattagttgatgaagtttcttcctagccttgatggtctttacaatttggcatgtttttgcagtggctggtagtggttgttcctttccatgtttagtgctttcttcaggaactcttttagggcaggcctggtggtgacaaaatctcttagcatttgcttttctgtaaagtattttatttctccttcacttatgaagcttagtttggctggatatgaaattctgggttgaaaattcttttctttaagaatgttgaatattggcccccactctcttctggcttgtagagtttctaccgagagatcagctgttagtctgatgggcttccctttgtgggtaacccgacctttctctctggctgcccttaacattttttccttcatttcaactttggcaaatccgacaattatgtgtcttggagttgctcttcttgaggagtatctttgtggcattctctgtatttcctgaatttgaatgttggcctgccttgctagattggggaagttctcctggataatatcctgcagagtgttttccaacttggttccattctgcccgtcactttcaggtactccaatcagaagtagatttggtcttttcacatagtcccatatttcttggaggctttgtttgtttctttttattctttttcctctaaacttcttgcttcttttcattcatttgatcttccatcactgataccctttcttccagttgatcgaatcggctactgaggcttgtgcattcgtcatgtagttctcgtgccttggttttcagctccgtcaggtcctttaaagacttctctgcgttggttattctagttagccatttgtctaattttttttcaaggtttttaacttctttgccatgggttcgaacttcctcctttagcttggagtagtttgatcatctgaagacttcttctctcaactcgtcaaagtcattctccatccagctttgttccattgctggtgaggagctgcattcctttggaggaggagaggcactctgatttttagagtttccagtttttctgctctgttttttcccatctttgtggttttatctacctttggtgtttgatgatggtgacgtacagatggggttttggtgtggatgtcctttctgtttgttagttttccttctaacagtcaggaccctcagctgcaggtctgttggagtttgctggaggtccactccagacgctgtttgcctgggtatcagcagcggaggctgcagaacggcgaatgttgctgaacagcaaatgttcctgcctgattgttcctctggaagcttcgtctcagaggggtacccagccgtgtgaggtgtcagtctgcccctactggggggtgcctcacagttaggctactcgggggtcagggacccacctgaggaggcagtctgtccattctcagatctcaaactggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgttttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatggtgatgggaggtactggtattacaaaaagcttctcccccgtgggtcaaatctaagctgagtgttgagacataattgaaattcactagatagataggagataggggtagggaattctaatcagagggaatagcacatgtaaggcaaacaatacagtgcatctgggaaagctatacaattttattgttataggacaaatgttggggaatgttgagagatggaactggagagtgaggcagaagttagcatttattcatttattcagcagacctttatctattacctacattgcactaagtactgtgtgagcattagagagaaaaagatgaatgagattggacaccattcgttcattcctgactatgaacttggcattgttctaggtaccagagatataataatgagaaacagacatgctccctcccctcattgaggttacagcttagtgtggagacacacagatgcctaacgcactatggtatggaaggtgctatggacacagtgctcaaatccatgatctacataggtatgagagtgacttttctacaacttaaatctgatcttgttattccctgcttaaaatcctgcagtagctcccagtagtgccttctggttaaaatacaagatatatagtatgacctctcaaggacctttgttatttgtctctggccacctctccaatttttcaccatgaccctggccctgtcccactggcattccatctccaatcacacggaactatgtggagttattaaaatgccctatgttatttcaagactcagagatttagtgcctcagcctgttttgttccctctcccctcctccacctggccttctccagctcactcatcaatctattagactcaggcatcatctgcttgccttcgtaaccctccccaccccgctcaccttgctggattctgtgcctttgcttgctggttcccagagatccctgcccttatttttctttgcctgctggatttgcagtgttgtgtcctatatggtgtagaaaaccagctcaggctcccacttctctgggcttatgtggtcagatgcagacctgtcttccatccataccaaaggccatcagggagtttcttttgtcctcttcaccagcccattcttaatctttctgataaattttctgcactgtgtgcgcgtgacaaattgggtcaaggtgatggtaatttacagcatgagatggtgaacttgctgcctgtgctgatgagcccattggatttcccctaactagtctgtttccctacccaggtggagaacttcagtagaggaagtggcaggaatttgggaatgaggagcacagtgattaaactggggccattcatatgagagtttaagaactcagaccagtgacttaggtgagtaaaaatatcagaaaaagggaaagaggataagagcaacttgggccataattaaacttgtcaatgaaatgaaggtctgttattctaatgcctacattttgccaaacctttgtgcttataacttcatcatttgctgtgattaacaaagttgaaagaataataactacttacaaggcccacatcacctccttataccactagcttttgctttccgtacagacatagctttaaaaagtgcaaatcctattctgtacctgagccacaaccctaaaagggaacttgtttacaattctaagaataatattgtcctttaaaggtgaaggctcgctggaaaacatgccattcatgtgataaaaagcaggtagcaggtagtgctaaagacttactagactgcatgtttgtgctttctgctgcattcctctaatctcaaggcagtataaggagataacatcttcacagccctttcagccctgttgcaatttctttgaccctggcctgatataaaaggcaaacttggtttttcactgttctagtcatgcagtttctttgtggttccctttagaaagacttgaggctatgagtcaaagcttttacgtcttgctgatagttcagagttgtgatgtgaagcaataaataaaatccctccttccacatacttgtctccttgattagaatcattctgggcaaatttagaggctcataaagtccatttagatatttagtgaaaaaacaccagcactcagaacagaatgttgataatgtagatggaatatctttctctctctgtctctgtgtgtgtgtgtgtgtgtgtgtgtgtgtatttatatatgtgtgtatttatattatatatgtgtatatttatatatgtgtgtgtatacatttatatgtgtatatgtatttatagtaaatatatcacatgtatttatatatagtaaaaaagaggggactataatatatctttatatgttagcatttattttaaaaagaaaacacaggaatatctaaaagaaactattacttataggggttatgggaaatgccatgggcaagaattttttttttttttatcaccatgctttctgaaacaacacgatatgtatcacctttataaaaataaaataaaataaaaaatgaaaaacaaagtccacttgtaaccacatgtcagtagcatgtttgctttcagggtacatcaaatgcattctatagcacaggatgttccagtcactctaacaaaagatgtcctgtttggaacaccaactctgtatcagttacttcagacactttctctcattgagtcccttcagcaagcccttttaggtttatgttcttagatgaggaaaccaagtcttagaaacattaactggccaaactaagatcagagagttagaaatgtcagagcccagaactggcatcttctgacttcagatcccatgtactttcccctacactgtgctgaccacacctccattactacagatgtgttgattacatctaggggccaaagtacacattcatccaataaatgcttactgaatgcttaccgtgttcagggcactgtggcaatcttttgtaatgcaagaaaaataagagtagtgaagacagtcaaggaaacaaagaagcctaatactaggcaagaagtgcttttgatggaattaagcacaatgagggtgttagtacagaaaggacatttaattgaactgggaaagttcatggcagttttcccagagatgagtcttgaaggacaaatggtatttagccaggaggaaagggggtcaagtgtattccagggagagggaacaacatgtacaaaagcacagttttgaaagaacactccatttttgaggaatagccaatagctgggcacgtctagagcatagggtagtagagagaaaggaggccggaaatgggaagagacttgaatgccacattcagttatgtggacttcatcttgtagcaatgggagcctacaaaattttaagtagaggaataaaaagattccatctaaaacttagaaaaattactttggcaggataagagacaatgaattgacggggagctgggtttgatagcaagaaactgtttgggagactgttctaattacatattttcttgtttttagatgcacatatacgtacttttttagctggtcatttctttctgaaattggaatgaatcttacaatcaatggcatgttataatttcattggcagcattatttgtctcttaagggcccccaaataatagtgtgtcacataactgatagcatctcaaattagatgaaatacagtagtccaggcaagaaatactgagatggtggggtggtaaagagggaaaagatttgagccacatttagatcctgatgtggtattaattattaagtaaaaaaaaggaatgtgcagtacatattcagtatgccacaagttgtggaaaaaaggtgtgcatggatagatgcacatgtatgtattcataaagttaatgtggatgcataaagcgtctctagaatgatacacaagaaacaaataacacccgtggcttttagtggggggcattgggtggctgagggagaacagcggtaggaaaatttttcattgtgttctattttgtacatttgatagtttgaactagtcgtattatgcacttcaaatatgtaaaaagataaaaagtaagagatatttagaaaggagcattgacacatttgttgacagattggttatgggataaaggcgatagtattttattgactatattttattcttttaattattcctctaatttcttaaaacaactttattgaggtataacttccacggtataatttcacccattttaagtgcatgaattcagtgatttttagtagagtcattgagtagtgtaaccattcctacaatggttatagcacatttttatcatcctaatgagatccttcatgctcatttatttaatctccattcccatctccatccccaggcaaccataatcttccatgtttttaaaatagctttgcctatttttggatgtttcatacaaatggaatcatacaaaaggtggtgttctgtgtctagcttctttcccttaggataatgttttctggtttataaatgttgcaaatgtcagtatgatacttcattcctttttatttgtgtctacaaaatactctattttatgtatataccaccttttgtttttctgttcatcagttgaagaacattgcagccgtttttgctttttgacttttatgaataatgctgttataaacgtttatgtttaagtctttgtgtggaagtattttttcatttccttgggtagacacctagaagtaggatgttgtatggaaaattaatgtttgactttttaagaaactgttttccaaagtggctgtaacagtttacacttctactaacaatgtatggaggttcccacttctccacatctttgcttacacttattattgcctgtctttttggcagacttaagcctagtggttgtgaagtggtacttcattgtgggtttgacttccattcccctaatgaccaatgatttcggacatctttcaagtgcttattaaccattcacgtgtcttctgtgatgaaatgtctatttgaatattttgcccaatttaaaactgggttgtttacctccctattcttgacttgttaggattctttgtatttttaactttaatttgactgaggataatgatccaccagtaaagagatgcatttatttctgtatttatgaaaatctttaaaattcctctacctttcagagacacccttcaacagactgcgcttcttattttcagagtatgtatttccatgataacacaagtatcaattataaatattaattacaactttccctcctcactgcagactcaaccaagagttataaatctgtgtattactttcaatgctcataacaatcttcttaaccaccataagcagactgaaaaagtcaatctagttgaattgttttactttataatgcttttataagatactcagtctgaaactgaaagataggtagctctagaaatgtgataaatggccacagaagtaacaacttttaataaattaaattatggatgttatgtcaattttaagtaatgtctcagttttatatcttgttacctgacctaaatatcattccctttagtaaaatatctattaaagctttgtggcaaaataagaacagaaaaatggtttttgattttcagctttctctggtgaataatttgttttcttttatttttccttctaaaataatcacacgtttcattgcaaccctaaccctcttcaacacacacacacacacacacacacacacacacacacatggcttctagattctacatgtacaagagtgcaaatcaaactaccatagaaaaactaagaagagaggcctagaagcaagaggctgatacactatctcaggcttcaacaaaatatttatctctgactataccaaggatgggcagagcttgcatgtaagtggcttgggctagcagactgggttttgaaggaggacaacatggccatgttcttggttcggtcatgaactgtctatggcacataccttaaatactgttggaaggatccgttagctccagagactgcaaccaactgcctatggtcataactcagctctcagacacattttgttgtgcccacagagtgctgtttgcctgtttggtttttaaaccaacacttaaaatgcagggaatttaagataaaaatttgataaaaatgggaagatttggccgtattgggctcatggtaactgagatgcatctgaatgacaggcattcctttgaattgcacatttgctcttgtttttactataggccactctcactttctgtttttttccccggctttgaaacgatcagttttagtactgaaaaattatctaggatactaaaaccagaatttctctgctagatggcttgctcattacattacctacatgattctgtgtaagggattgtgtaagttttctatggttgccataactatcacaaacttgatggctttataacaacagaaatgtatttacagtttggaggcagaaggtctaaaatcaagacttctgattttagtctgtccaagagcctctgctggtagggccatgctctcggcagaggctcttggggagaatctgttccttgcctcttccaccttctggtggcttcaggtgttttgtggcttgtggctgtatcactccaatttctgcctctgttttcgtatggccttctactctgctcctttagtctctcctttaggctgtttcttataagacactcacctaaaacccaaaaacaatctaaaagattttgcaaatatgaacattctaattaccttagagttaagattttcttttctgctaagtgagggcatggtgcagagagcaggaaagatgtgaaactagatagcatacaaaaataggtgttcatagatctgggcctaacaagggtgtggccagcaactctgccctgctttatcagcattagaaagccagtcctctcagaaagtgcccagttagctaaattcatgagattatagactattaaggtggaatggacctcagagatggtccttgctctcatctgaggcttcagttgggccagtcagaaatgtgggaaaattgaggcaggtcaaataaccaggagtacaaacaaacacaatctatccagaaaactagaaatcttactagtgactattcacaggttactttctgcattctggggttttcattctagaacagatgtgtgtgtgtgtgtgtgtgtgtgtgtgtgtgtgtgtgtgtgtgtgtggtgcgtgaagagaggggaggggtgcccagaaaaccatacccactttcccacatatcccaactatgactgggcaattatgtcattatcaccactgatatatagctggaagagtttagtgttgccctgctaagatctggattttcttttctggagcttggctattggggcattgagaagtccagccaggaggttggtcagaggctaacccaaaaagctttgcttaactctgggctacagctgggggttgccagagagaagtgcctggcattcctgcatgctgacatcaagcttcgaagttgctgccctctggtgagtcagcagcaaaggcccacatcgttcgagaatgctgcccaatcagaagatgtgatgccacacctcagaaatctttctaaacctcagcattctgtagacttcaaacaactcctcctgagaaagaatgtagaaataattaaatttataagattaaagttataaaaagcatagagcctataataataacagcaataagataaactccacatttgcttttaaaacaatttatttgagtagacagccaaccccctgtattgtactcctttaaaaaatattttaggctttttaaatgctgaggcaaggggacataccaaacactaacaggcacattggggttttctggctattgaaataaaaatgtccttacataacactgatgtactggaatagcactgcgttccagtgacggttattgcaactcagccagcatatctgtagcttgtgagcttttcttatcagaattttatctataaatatacatatacgtaaattctattgtgaaataaaaataaaatgtagaatcttctcatctttcttattagtcaatattgtgctactctttaataatttctctcaattttttcattaagcagatattactagggaaatatacatgaggcagaaggcaaattatttgcttagtgcaatgcaaacttgcttaacaggtaagagcagagtcccttccatagcattgccaccatatggcattgccatatcgtggaggccataaagaggaatgacattgtaaagattaactggattttacttggcaaggtcaggcacctagatggcatgctataaaatggttagaagtgcaaaggaaacctgtagctagaggccatgtgagattatggaagtgacttttcttacaatcctgccatctggtttggattgtcaggatcaaaacatttcacttgcccaagtgaggatgctctctacatggttttggggatgagggagactcagaaataatgtttgtggtactgtagcaccactaggaaaagagaaaaattggacctgacatgaagaaaagcatgcagccagccactaagactacttcccacaggactggaaatctctaccaccgtacctctcctacatgctgggtataagaagttaaagggaagccagattatatttacctactctttcattcattcattcactcattcatttattcatccatttaccatttgtttgttttttgttcatttacttatttaataaaaattgtgttttgcatattctaggtgccaggcattgaagaaccactgttattgttctcaaatgactgacagtttagaggagaaaatggaagaataaatagacacttgtgatgcaatataatagtgctctaataagagcaacatatattgaataccactgaatattaaataccagggactttgctaggagctataaattaatctccacagtacatctaagatagaagttttataattactctctttaggaggaaataggggtctatagaggttaagtctcacagcctggaaggagtcaacaaaaaaatactcagccttaggtattctgactagaagcttgggtccttaaccacctactcaccaatttgaagaaagatgattgaaactgcaacagctacactgactcttgaaagcaaagtaactcgttaaatgagggtatgtgtatactggctgggatattgtgggctcatgatgacttgtaggccgaggcagctgcacatatgaagactatggagggtatatcatcagcggaaatgaaagtgattagtgttggaggtttcagtgcatattctggttttctattactgcataacaaatcaccctaaaatttagtgacttaaataaacatgatcatttatttagctcatgaatttgcaagttgtgcagcacttgggtgggatagctcacctttcttccatgcagtgtctgctgggactgcatgattgcatgaagcggggctgggcagctagagctcttcatgaatctctatttttgcatgatattttcacaaggtctctcaagcatgggagcttcaggtagcagaacttctgacagggcagcttagtcctttgaaagtgtatgtctgaaaagagagactcaggcagatgctatattgccttttgtgaccaagccttggaaatcactagtctctcttgtgttgaggtggttataagagcctgtccaggttcagtagggagcataaatttcacctctgaatggagaagtgccaatgtcctgaaaaagcatgtgggcccagaaatactgttgtggcaattttttgaaaatcaagtgtgataaagacagcatagtgtagtcataaaaaacagattaggagcatgatgtgctttgatttcaactatgggctttattacttactaactgggttactttggttaagttgtttgactcttgttttttgagatggagtcagtctgggagactccagctctgtcgcccaggccggagtgcaatggcacgatcttggctcactgcaacctctgcctcccggatacaagcgattctcatgccttagcctcccgagtagctgggattacaggcacctgccaccacatctggataatttttgtactttttttctttttcgagaccgtgtctcactctgtcacccaggctggagtgcagtggcatgaactcggctcactgcaacttccacctcctgggttcaagccattctcctgcctcagcctcctgagtagctgggagtacaggcacacgccaccatgccaggttaatttttgtattcttagtaaagatagggtttcagcatgttggccaggttggtctcaaactcttgacctcatgatccgcccgcctcagcctctcaaagtgctgggattacaggcatgagccactgtgcccggcctaatttttgtatttttagtagagacaggattacaccatgttgaccaggctggtctggaactcctgacctcaggtgatctgcccaccttggcttcccaaagtgctcggattataggcatgcgctaccgtgcccagcccaagttgtctgactcttaattctcagctttcttatttgtaaaatgaaggtactagtactaatttggagagttgttaaagattaaataatatatgtaaatgccttggcataagggactggcacaaagtaggcacttcatatataaaagctgtgattattgatgaaccagtagtgaggtacataactggggaaggagaaggggccagtttgtgggaatgcttttttagttattaatagtaaggtggtaaaataataatagtaataataaccaaaagttactgaaaactaaatacagtgctaaactctttaaaaggagtatctaattggatcttaacaacaaagctatgaagcaggactaatgttatctcattttataaatgaggaaatgtaagatcaaacaggttaagaaactttcccaagttgatcagtagcaaagacaggattcgaaccaaggtaattgtcctatcagaaactgtactaggatagtctgcatttcatggtaaagactatcagatgccactaaaactttttaaaaagggaagtcttgtggtcaaatttgctctttagaaggcagtatggagtgcagatcagatgctggcagcagggagatcagttagaagatggttgctctaattcagttgagaaatactgagacatctgaaatattgaagacatcagtagtgtgggtgatgtgaaagtggttctaagaaactagcggcaatcatccttcattactgattgggcgtggagagaaagagaggtagcattggtagccgttagtcaactctgagtgcaggcactggcatgtgcattattacccagggctctaagtggagaaagaaaacaaccccagggtgtcttcaaacctaaagcatatttcctaagcctttgcactctcagtctagactaaaaacaaacaaagcagcctcctctgaaatgctggaaactttccccacttgaaactctcagatctcttaccttgcaattctagctttcaaattccaagctgagcttcctttcccacaccccgagtccttgtactggggattacaatgatcatttgtatgtactaggtgattgttccttccacatcaggggccttggagcggatgacctaaagctgctttctcctgtcctgactttctccacccagcactgcaaccatacatacaattttctggtcttgtagagaatgactgactggtcattatagtcttccaaaaggataagagattagtgtcatgatgtggccttcaggcagccagggggaatctccatatgaggtacttgttgactgtattacttagttttaggtgaacttcctgtggagggacaatatgtgcttagaaggacagagaaggaatgtattaggtaaggcattctacatctcagataaagaacttcaatgaattgttgggtcaaggtctaagaaacaaaccagccgtcaatgggaaagttaactaaaatgaagaacccaacatacaaccccaaatcctagtttttctgactatgttttcttaaactgaaataatttctgagattaaaaagaagttgctgtgactttgtctgatagatgtatttttttgttatatattagtttgggccttctatctctcctactttgttttctttataatagaattaatctctgaaaagtaactttactgtattctgatgctccattttgaataagtcagttcttctccgaatgggctctggagattggcatttgattgaacagcttttgtgtattgattgttttaggtagactgggtactccatttaacttagtatttctgacaataaatcagtcgagaagggagtattactctaacggtttgaacacttgtctatgcacattgcttggtcattcaataagtagttattggtgagatcgggcacgttcagggtggtatggccatagacaataaatggttacgactctgccttcagctgtaccagtatttaagttataaggtagttaagttacaccagtgcaaaatcatacagtttggtcacagtcctacttgaggatctcaaacctagctccccttaacaaacatggaggcttaatcttggctttgcacactgaattattcctttagaaaaatacttggtgtacaactcatccttttcatttacaaagaaacaaatttgagcagtttcacaatttaaaaagtctcccaaatggattatatttaattgtccatttccaatgaaactcactaaattggtaaatagcagtgagtgaataactgatgaggtcatactttcttgttttggactactacaaacaccacggagcaacaacagattagaatataaaggttaagcaagggtttagtttttgttcaaaagccgttttgcttgttacaaaggctaccaaacctttgaacatcagaccaaaccaaaaacaaaacaaaacaaaataaaaaaaaccccaaaactgaaagatgaaaacatagtttgataatctaagctgctcttcctttatttaaccttgaatttatgagattatttttttccccagaagaaaaattctcttagggacactttcagcaatttaacattttctaagcattacagcaaataagaggcgatcatcattcttcagtcataaagataagccaaggaatgaaagtgttttgcaggtcatgtcacctgacagaaactttggactggtcctttcctggttcaagagttcagccataatacctactttccctatcagctggctcaagctgataaggtcctgaagcaagcaaagcttctttatgagcttttatttaattgtccttgccacataagggttgaggggattcgtctgtacagagttacttcttgttggtctattttttctttggaataaatcgctgtctcccctgactggatagagtaaatagagtttgtttaaacacttttcatcaaattcctagtgcctagtacagagcttttaaccctaatacgtttcctgcgtgtacttattgaaggaataatgacaaactctgccttagattggtgactggctagggagaaacatggttcaagagctgaataagtaagagcaagtattttattgtatgcccatcaaatgtattcgatgctggtgatggaggtaagagtgtgatagaggctgagttctctgaaattacatatgagatgtcatctgccatttagtattagctgtgtctgtcttttttccaggaatttggccttaaaagagatcattcaaaagtattacccaaatagtgatttatcaggctttattgtggggaacctaaagtggattgcaactgctatggtccctttgaagggagctggtgcaagattttccatgcctaatcacactcattttcccttgctctcccaatgacctcccatctttccttctatttggtctgataaacaccaacaataggatcctttctgcagcttccatcctaacttgtattctagccttaacactgcaacaaactcactgttacctagaagtcaattgacttccctgaatgttagcttctttagctgtaaataagtaattgtatgaggtgatggttaaggtgatttactaattttacaattctattattttatgaatagaccctagttaggatagtttgaaatagatacttaatccactattattctctcttctaagatatagttactagttgatcatacttttccttaaaggctgaactgaattctctgatatcagcaactaaacatctcatatttgtcagtatgaacatccactgggtgcctgttatttaaccaggtagaattcttagctgtgattgaaaatctaggtatctcttctggtactatcacttggatgagtaaagtttgaaaaccattaagttgacatttctaataggactgtggatttaacatagattcccagaagtcttggaatacaacagtgtacacagatgaagatacagtactttttggtattttctttttgcaagtgttacaaatatctgcatgtcataacatcatcactatggatcccatcttttaatgagagcttagtatatgctacacactgtcactaaacatgtaggatcttgtttagttttctcaaaatgttgtagttactatgattattttttgtgtcttgcaatcattgtgtataagtgcgtaaaccatgtatctagagtttatagaagaattaaaattcaaaaaccctatactcatctctcatttttaaaaaataccattttacctgtctttagatgccctgtatttcctccccaatctcatcccgctcctactcttgaaagtgatcactatccaaattttgtgccaaacattaacttgttttctttagctttgccatctatgtatgtatccctaggtaatacatggcttagttacacttgtttttaaatttgatgtaaatgtaatcctatagtatgaattttctaagacttgattaatctatgaacattttattttgagattcatcaatattgatgtgtgtagctatagtttattcattgctgttgctgaaaaatattctattggatgactttgctacaatttattctaccattgttggatatttgagttgttcccattttatttatttattttatttttttgctgttatgaacaatgtggctttgaacattcttatactacctggcgtgtatatgtatgtatctgtctgtctgttcatcttaagatgcactacaaaactgaggcctagagtcaccaagcaacttgtttaatgtcagagtgagttggtggtgaggccaaagtctgaattcagcagtctgttaccatagttttcatccttaaccacaatactctatgaatccttattttaaaaaggaaggtctggagaatttaaaataacttcctaaagagcagggattcaacaaagctcagtctgactaatgccttccatttttaaaaaatcacccaaagcacatattatgattctatttgtgaagtattagctaattacaagagaatgagttcatacttggcactactatctctttcttacaagtgatcagatgtcaaaatgtgaaaactatacatttcacattatccatatatatgtgacatttttcctttaggaatatgagtagaaatagaaagacaggtttttacagtgaaatagattttttttctctctctttagcctaccaaatctctttcgcaatacctaacacttataaatgcatttaatttcagtgccaattaaagaaattcgaaagtagataataagtgagacaagcacccagtaaatgtttatgatgtgacactgacaaattatgggctgctataatcaagatagcattaaaaattttaaagtgtttgtatgaacaaaccattttggaaggagtgtttggtgtggcagtgagcaaaacaacccagtaactatggcagttagtgttaaagctctgattttgacatgaaaggaataaaaatggaagtccagctaaatcacaagtgtcctggagaaacttggatgagtttcttggctagaggtttttcccaccacagtaagtattttcaaaggaaaacaaagtaaaatttttctcttgtatgagtcacatctctgttggttgtaagtggctgaaactcatcttgaactaccaaggtaagagaagaaacatactggttaatggaattccagaaaggactgaacaatcaaaccattttgaaggacagcatagagctggactctagaacagccaaaacaaggggttaaaccactgcgagggatctctctccaactcttgctcaggcttttctccctggcttgactttcttctctttcactgtagattggcttctctcacatggcaagaaacattgctgctagcacttcccgagttctacgttctacaacatccaccactggtgagagattaacttatggtttttctgttgaaaagtcaaaaattacctgggaaaagtctgattgtctcagattggagatgttgcccatctctggaccaatacactattatgtgtggctgactatataaaaacatggatattttcttggaatcacttggtttgactgggagaagaccattctcaaaacaaaggaagtgcaatttatagaaggtagtagaataggcagataaaacaataattcttcactatattgctcaaataatccccatgacatttttagtatattataaagagagttctaaagtgtttccaaactattatagcaaaatttaatcttataataatttcttcttgaactatgtataatttacctgaaatattttccaaaaagcaatcaatgtgagaaaatgagagccctgtcttcttaaaaaaatgagtaaaagtccacaagttcagaacaaaagaaaatgaggtaaggcctaaaataaattgtgctaagaaagctaaaattctagacaaagtcacatcggcaaaactagaaggttggtactgtgcttcagtttactgcttgctgtttggttaagaggaggggtgatgtgataaaaatagtgacgaagtgagaaaactgacgtattagttttctattgcattataacaagtcaccacaaacttagaggtttgaaataacgcccatgtattatctcgcagttcctgtgtgtcagacctccaggcactgcgtggctcggctgggttctctgcttagaatctcacaggtcaaaatcaaagtatcaatgggagctgcagttctcccaagctggagcctgtgtcccttttaaactctcaggctgctggcataatttatttccttatcaagccatccatatgatcccctccatcttcaggccagcaatggcctgtcaaatccttctcattctttgaaaatctctgacttccctttctgtcacagctctgtaacttcttttctcttctgccaccagcagaagaggcttttaagagtttatgggattagattacatccgtctggataatcttttacttaaaggtcaactatgctatataacatagccaatcacattcgcacattgcagagactagggtataaaatcttcggggtcattcctagaaattctgcctgctgcagcctggtttcttgcttggactctagtatatatttgctaaatctcccaagcctcagtctcactatttgcaaaagtgagttttaatgctctttgccctgcttgcctcacaggatcttaacatagacgtaagatcaaatgcaatagcatgtcaaacaatgtgtaactccagttatacaaacattactgtatctcattggggatacgaagctctacacacttgaagatggtgaaggaatataaaaatgtaagtattgcttttataataaatgtgttcctattggctgaaaatttcaatatctgatacaaatagtcaactttctattttactttttctaattatgcaagaccttgtaatcacaaatgtaaaaattgcaagccacatgcccctaaggccaaataaaaatttgtaaaattctcttaaaaagactctatagagtccaaatgaaaatacgtcgagtccttttaaaaggatccaaccacatatatcaactgatatacatggtaccaaaaacaatggaatcttttcagattctctaattggcctttggaacttatgtagcatcaggtatgcaaatgaacaacttcagaccttgattactccaacctcctctcccactgtcacagccacttctgtcatgacctagttgttctcagaaagttccctcttatacctggtcaaacttctcttacaatcacctgtgactttccctcttggtcttggatcaaatcatcctaaatacattaaaagtcctgattcttcctgtcccttaaatatatctctacttgaatcactgtgttagttcaggtcctctgagagaaagatgttaagatgaaattagatgtgcaagagattcgccgaggtaaaccttgtgggagaaaatggagaggtacatagaggagcctgggcagactgtgtggctactatgtaagactcatccccatgaaggagaaaggagaggaaggcaaagaagaaaaaccttaagatttcaattctaagaacgttttgacaaagctgattaggagtatttaaggcaaagctgcccaccagaagagtactgcatctttcaggaacggacttgctttagtacatctgctgtgcttagtaattggctgggagcagccatagaaagcatggactcagtacaaacttggtgatgaatttcagaggcagcggctaagaccatcagtctattattttccttgcaatagctgtcataattactatcagagcaaacaattttttgtgtgtgaattcatgagataatggtcttttctttcctgctttcaagagccatgtcattgaaagagctaatcattcaaatttatgctgcattactgactaaatactttcatttatcatactttattttaaaatactttaactcatggcccgatgattttcagttaaccaaattctcccttactatcctggttgccccttctgtcttttccttagaaatgttattgtagtatttgcaagatggcctgaatcctgaaccccccatcttcaatgagcaccaaatggtaattatagattcccagctgtagagctatgtcagacaaaggaaacttcattagtatgtaccaatgtttggactccaaatgcttttgtgtctgagtcacaaggactcctcttccttggtggcttaaagttaggctgaagaagatttacattatgttgtgcatgacctctttagtttggttctacttatactttcaaggagggaagactggggaaggtgtcccttagtgagcatattttgtacaaatgaaaacagggtactaacacttatgccaggacgcatgcataaactaggatggttctgagaaaactgcgatatatgatcactccagggtctcccctctcagaagcgagggagacttaaaccttttacatcaccaagtacatggaaagaaagacagcagggaagtgattccgaagagaaacctgaaaaaagcaatgtggaaagatagacactttagccttttctttcttctcaaaacttcacattccttttcactctgcttcacttaagctgccctagttccagagtgtttcctctcttgggtgaagatgggaacaagtacatggggtagcaaggggtgggtgggacctgtgctcccattaaggttcttccagaatcatttctatgtgattatcagcttggatcacatggacttggggattattggtggttttctagggtaaacagggcatattgtgctggaggacatattttatatgtaacaatttggggaaattttcttttatattaaataaaactgagatatgtaatgaattaggatgaaaaattcatattcatctgaattttataagtgaatcatgagaactcaaagatacttagcccttgggaccattttttactcctgttcggatcccttcagctaagcatgattatttactattttcagctattagttatgtcttgttgaaaaagtatgaaaagagctgcccaataaattagagtgtatgctcaacattctcttagcttctttatctctttccaaaattggatcaaatgacattggacatgatcaacttcttactgttttgacaaacatctgaggatacttttataattgataatttggactagattatgcaatgtgtgatgagacacaaggtagtctgtactccccatgatatgtatatctgtttgatatactcaaacggtgtatatcaaacggatataagtttgagtaggtatggagatgagccagggtttatttcttcaactagtatttactgaatggtcttatgtgccacaactgttctggaaactgtgatacattaattaacagataaagcctttccctcacaatgcataacagacccaacagagtatgaatgtacatacaaactagtaaataagaaaacaaataaaagtattcagatagtgctataactactgggatgaaaatcgagcaggaaggaaaatatagcctgcttgatgtggaagacagggatagcctctctgaggaggtgacatttgacccaagacctaaatgaggagaaggagacagtgagatgaaaatgagggaaacagcaatggcaaatacagagaacttgagacaacttggcccattggagggacagagacaaagccaatgtgggaccacaggggatgaaagggaggctgattggagaaataggcagtgctgaggccataaaaggtcctataggtcatggaaagacatttggttaccattctaatgacagtgagatgttactggggagttttaaactggagaatgtcataactgtccagatgtaaccaaatagtaaaaccattcttcctgaataacttggctaaaaggaatattatgactacagatgtacatgaagattaagcagaacatggaagaaaggcctcaagtaaacttgacctcacataaatatgggaggaagatcaaatggaagctgggagtgttgaaagaatgtaaggggaatgacttctaataatgaacaaaaagctgttattttattatgaagaaaaatgttatgcatcttatgcatgcagaagaaattcccattcaaaagacttggaaaatgtcttgggtgtttactataataaaccttttaagatatagaaaattcacatatttagagcttaatttctaaagagctcagacttctcagtttattatatgctatgaaattttgtttatttttaatttaacctacttgtgtgcaaaatcaataaggaagcttaaggaatataaacaactatttaacatggccatttaaatagattcaaagtaaagaatatcagcatagtgtttctttgatatgacaacccctcctcccagggcacttaaatgaagggttgggggggaatcttaacctgaaattgaaaaccctgaaatcatgtttccaaggaaggagaaggaaaataggaaaaacaaaaacaaaaagcagcaactcatttggaagctcgtgggagaggagaggaggattcatacatctcggactggtttgccttagcaagtgaatcatttaaataggaaaaaacagggggctgactcagcttgagcaaactcttgctatcccctgctgaggtccgcacttgctgtggcccctgccgctctcctcggaccttgctgccctcctcctttgtcactgtggagaaacaggaaggaatgtttattagcaagactgactggggtcacacccaaggcaatatcaggtttttacctctcccaggcctgggaagaggttcaaggatcaaggacaagctcccggttagagtgagaggcaagttcaaacctttgaaaaataaactcacaaccagcatttggcacaggcctctggagtttacagaatgtatctgcctgtgtgtgatttcattagttcctcctgccaatctaatgagattttacgtcctgtaacagtgaggcaattggagtctcagcagggaaaggaacttgcctaaaactgcaggatgggtagcgcttggatcctgactttctgactcctaggactgtgctgtcttcagatgatcacatgccttcttggcagatgtttctaacaaaggagagagttgcccagggtggggctctgctagctcccttgtcatgagccattctctccacattgccttttagttgcaccacatagtcaccttcaattagctgtgcgaataggctcactcttatgctaacatgtactaaaagtgaaaatggggagagagagagagagagagaaagagagacacacagagagagagactcatattatggtatgttccctgccccaccccactccactccctctcaacagggagaaagtacctgaagaaaatcattgctatgaagggcatagccagctaaatgggtgtcacttagtctgaaaaatctcaaagatgtcaataagccactcgagacaacaaggaacctgttttcctgtcatcattccttctcagtccttggctttgggaagggtaactttatggagagagaagaacctctgtggagttaaaaggtttatgaacttttttccctgcaacaaatcagtgacagctgttccacaggctgatggttttccctttacctttcgttttttaacagctatgtctcacagtccagacttggagtacaagtaataagaagaataaaacttaatcccttaagtagattcaccataagttagctcagagcaattccagtgcaagtatggtctgtgatccagtaggtgagtgactctgctgctgaaattcacatgtatgtgaatttcacagtggcctttgctttgtagcatgctgtaatccttttgtccattttcatcacacgaactgctgaatataggattgttaaatggatggggagatatcatgaaaatgattaaagaagaaagttcttatttaggggtgcatacctgcctatctgaccattgtacttaggcaatcgggatcttgctttaagaaaaggtaggcattggagtcaggctgctggagtatgaatcactatgctatcatttttcatttgtttttgctctgttacattaggaaagttatgtagaattttgtgcctcagtttcctcattcaatatgggtgtaataactgtgcctgtcttgtaggattattgtgaggcccaagtgcaataatatatagtacactgtgtctggcatctagtaagcattcattaagatgacatgaagataacacagatatatcttaacatgtaattatgattttgcttattcaaggccaagcattccaatttaatggagttaggcaaacacagtaaattcattgctctttcctttttatgctacttcctttgaagaggcagtcaagttccatttgactgattcggaactttttagcaatgtatattatgctgacttcactcttatgcgctcttggggctataattcatcaagttaggcgagcaaagaagtgtgttggtgaaagagaaatgaggaagaacaaggaagaaaaaaagggtcatgagcttattcactgccaatatttattatatggaacaatgaccatccttcagaagtgtttgttctctattatactgtaggtgtggaagaattatcattgctcaatagctgtctcagtcactacctgatagacttgggaggtctggctatttcagggcgcatttgacatacagtgacatttttggattaaagctttcatgatgagtgccagtctgggtccaaaagggttgaaagctgtcgccatctataggctagttgtttgtagtaaaatactttccctcactgcattaggttcttggtaccatttatctagcagagttcttcagtgggcttgaggcttagcagtcaagttaaaacaataaccaacatcccaaacccagtggctgtcaaatttcagtgaggtggcatagaactttagcatgaacttgagcttgggttcagctagactttcatataaatccttgtttgaagttagtagctgtgtgatcttgggcactgatattaaacctttatgagaaagttatgtctgaaatatgggaaataaaccttccacttaggttgttgtgaagattcaatgagttgtaacgattgtatacactataatgatctatattacagttgtttcataaatatgattgccttcattttattctttccttgtctcgttcttcccagtatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagtaagtgctttgtaaaatgtcaggggctccaggattatatggtattactgtcactattgtaagcacttctaccttttttttctccttttacaggttaggaaattgaaatacagaaagatgaaaagtgatttgcccaagcatatagatcaaagctgtggcagaaccaggactggaacctatatctctctactaatggtttttttaaaaaaataaccttgtttcaaaaatattaaaaagtcacaagaaaggtaaacatgtggataaacaaaatgaagaaaataaaaattatccagtaataacatattggcatatgtctttctggtatattttcctgtgttgtcatcattatcatctccatcatcattatatccatcattatcatcatcatcatcatcatcatcatcattatcatcaccatagtgaacatgtaatgcttacctagtgccagatgctgtctaggcattttacatgtgttactggtaactcatgtaatcctcataacaaccttataaggtggttgctattatccccatgttacatatgaagagacagaagcataaagaagttgcaccgctggtaattggctgggatttgaacttaagcagtctaaccttagagtaatgattttaacaactatgctatatacatacaaatttacaaaataaaactgggctcagacaataaaaacagctctcttttcatgttataatactttttcaccccataacacataatcactaatgttttaaagatcaaaacaatgcacataaaatgtactggttttaaaaaaaagaggaaatagccacttacctcaaccaaactaacttggagatagattagattgataatggcaagggtgatgggtagatgggtagaggttgctcaaaaagaaacacaaaatatatcctcttttaaggatcctgatgctttgctcaaagtaatttttattcttttaaaactaaaaaaaaactgtacaaaattcatagggtacatagtggcgctttgatatatataatgtatagtgatcagatcagggtaattcgcatacccagtcatcctatagtgggtatagaacaccagaacttattctttctatgtagctataattttgtatcctttaacaattctctccctatccctcccttccccctacttttcctagcttctagtatcctctgttctactttttacttctatgaaatcaactttttcagcttctgtatgtgagtgagaacatgcggtgtttagtaggaaatttctgttcctggcttatttcacttaacacagtgtcctccaagagcatccatccaggattttattgctttttatggcttaatagtatttcattgtgtatatataccatattttctttgtccattcctttgtttttggatgcctggattgattctataacttggctattgtgaatagtactgcaataaacatggtctgtagatgtctctttgatataatgattttctttcctttggataaattgctagtaatgggattgctcaatcataccatagtactattcgtagttttttgaggaacctccattctgtcctccatagtggttgtactagtttacgttcccaccaacagtgtataagaattcccttttctccaaatccctgccagcatttgttatttttttttttttgtctctttgacaatagtcatcctaactggggtgagatgatacctcattgcagcttcaattcacatctccctgatgattagggatgttgagcattttttcatatatttattggccatttgtatgtgttcttttgagaaacgtctgttcagatcattttcctactctttaattagattgtttttactgttgagatgtttgagtcccttatatattctagatattaatctcttgtcagatgagtagtttgcaaatattttcttccattctgtagtttgtatattcactctgttgattacttcctttgctgtacaaaagctatttggattgatataatcccatttgtgtattttgtttgtgttacctatgtttttaaggtattattcagaaaatttttgcccagaccaaggtcctgaagcatttcttctatgttttcttctagtaattctatttttcatgtcttacatttaggtttttgatccattttgcaatgatatttatatagggtgagagacgggaatctagtttaattcttctgcatatagatatccagttttcccagcaccattcgttgaggagactgtcctttacccactgagtgttcttgatatctttgttaaaaatcaggtggttgtagatatgtggattaatttctgggttctctattctgttctattgatctatgtgtctgtttttataccagtaccatgctattttgtttactatagctttgtagtatactttgatgtctggtagtgtgataactccagctttgttctttttgcttaggattgctttggctgtttggggtcttttgtggttccatataaattttagaatttttttttctatttctgtgaagaacgtcattagtattttgatagggattgcattgaatctataggttgctttgggcagcagatatctttccatttgtttatgtccttttccatttctttcatcagtattttgtagttttagttgcagaggtctttcacctccttggttacatttattccttggtattttattgttttcgtagctattgtaaatgggattgccttcttgattgctttttcagctagttcattgttcatgtatagaaatactactgatttttgtatattgatatcgtattctgcaactttacagaatttgttattagctctgagttttttggtagagtcattagatttttctgtatataaaatcatgtcatctgcaaacaggaacaatttgacttcctcctttccaatttggatgtcctttatttctttgtcttgcctagttgcttgggctaggacttccattactgtgttgaataagaatgttaagagtgggcatccttgtcttgtttcagttcttagaggaaatgctagtgtagctgaggagagaaatgaaaacagaataaaaacttcagtagaagttggggagaaatgtgtttgcaccaaaagaggtgagggatggaactgagggaggtctcgaggggtaagagaggccaaagagctggcaggtgctgctattaggatggccaatgatccagaagtaatgatgaatgagaagatggattaaaaaaaccctgacattgtttaactagaagaagaagacagtcagagagaagtgagggcttacttttcatgtttaaagtctgttatgtggtaaagggattagatttatctgtgttgttccaggggacagaaataggacaaatggatgcaaatagagtgaggaagatttaaaacaaatggagaagacattctaaaatcaactacaatgagcgtaaacaatgacaacggaaaggactatttttgcaattatgtagctcttgttctctatagatagatgtgtaagcagacgctgaataaccatttactgaaaatataaataaaaacaaagcaaattgcaggcaataaatattgtattagttctcattttgtaaaacttatacaggtatcatatgcatagacaaatacaccaaactgatgaatatttgccttgtataatctttttgtagtttttttatgaacatatattactcaaacaatttagaacatttggcaatatatatatatttcatttataaaaggttaggaagattaattacactttctgaggtcgcaactaaaagccaagattttaatccatttctatttgatgtaaagtctggtcttttttcagcaaaccacaatcccacattttaagggcattaagaaagggatgggtagacaaaatgtagaggtagtaggtacagaatacaaagtttcaagaaattaaaagcttctaaactaacaaacagccaatttgtggagtgtcactggaaagtgacaaagaggacagttaagttagttggaactgaactgaggccagacagggctgtgggacaagtcagggtgtggtcattccggtaagcagcgatgcagaatcaagacagagtagtttctccttctctctctctctttaattgtaacgccttttataacaaacaaatattatgcttatttctgtctttaaattttttgtagtaatttctcatcacttaacctctattttttaaaaaactaacttttctcttgtttttctagttgagctatcattcatatttattatgtggaactagaggtagtcctggctacttgggaacagcgtggagtctagccatgtcagggccagaagtcgtctcagctaagttagaatgtgataccattgtttacacaagtgtggcctgccttcaagatagggtgaggtgttttatgaccacaggctttatgagttatagctataaaacaatcaatcttttaaagcaaacacaccacaatgtctacacgcaaatgagaattgtccttcagggctgtgaccttgggaaactcttcacacatactagcataaaacatatttaaactcttcactgaaaatattattcagacctagtttctctctcagtctctctctatgtttctctctcacatgtacgtgcatgcacgcacacgtgtgcacacacacatatgctcacatcattttaagatacatctcatttttaaccaaaaccattttatcttgcttgataaccaattttatttgttagatgacttggctataaatgcctttggctatcaggaaaatcaaatcaaaattaaaagacactgttactactgaagaagtaaaaaaagaatgggctgctgactctgaagatcatacccgaagtagagctgcaaagatatttggaatattggtaatatccaataaagaatgaccttcatgctattttgaggagatgtttaaatgtcgaattattgaaatatttataaaatacaaataaactaactctgcttcatattccaacttgtgtatgacacttcttaggctatcatttcattccaaatttatggtcactaccctactgtcattcctcatactaaccatatgatcaacagttgaaaagcagccactcgcagaggtaagcaagatatatggtaaatactgtgttgacaaaagtatgcagaagcagtcacatttatacagtagtgaaggaaatgtaaattggacaaactttttggaagataagttgagaatgtcaaaaatcaaaacacactttctgttttattcagcaattatgagccctttgttttacagctatgctcacaaatatatacaaacatgtatgcacaattatgttcactgtggtattgcgctagaaaaatactaaaaacaaaccaaatgttcatcaatagggaaattgttcaacaaattacagtatatctaaaaaaagaataatatataacaactgaaaaaataaaatagttgatataagcagatattccaagatctgccagacatattgttaaacgaaaaatctagatacaaaattgtttatagttctctttcatactatagccaaagaaaattcagaaaaaactacttacagttgatccttgaataatgcagcaggtaggggcaccagcttcctgcgcagtcaagaattgcatataacttttgactcccccaaaactttgctaatagcctactgttgactggaagccttatcaacaacatcaacagttgattaacactggaaaaggaggggttggtcttactgtctcaagggtggcaaaggcggaagaaaagccacctataagtgaacccttgaagttccaacctatgtttttccagggcaatcatacatccatgtccatattcatgatgaatatgtgaaagggtacataagaaaatgtgatagtcgtttcctctggagaataaaatgagaggtctatcataggtgagaaaataattttttattatatattcttttgtaggtttatttttttgtcatgtgtatgtattcttttcaaaataataaaaacaataacaacgattaaaatatacaaggggaaatgcattggccaaggtttagttgagagcaaagtttgcttatctttcgaaagaggtgaactaagcttttcctttttctctttgggtatacttgaatggggatggagtaagtggattctttttttttttttttttttttgagacggagtctcgctcgcccaggccgactgcagtggcgctatctcggctcactgcaaactccgcctccggagttcacgccattctcctgcctcagcctcccgagtagctgggactacaggcgcccgccactgcacccggctaattttttgtatttttagtagagacggggtttcaccatgttagccaggatggcctggatctcctgacctcgtgatcagcccgcctcggcctcccaaagtgctgggattacaggcgtgagaagtgagtgaattctaaggagtatcgagaacagtgattaaaacagaaggtggggaggtgtcataagcttatttgtaggtgaagtattaagactagaagaatgacattatgcatcaaatcttttacattgtttgatctcttttacctaaaaacaaaacaagatacttttttgttgtttgacatatgaccaattagcagccagttggagctaaatgttttcttttttctttttcttttctttttttagatgtagtgtcactctgtcgcccaggctggagtgcagtggcgtgatctcggctcactgcaacctctgctacccaggttcaagcgattctcctgcctcagcctcccaaggagctgggattgcaggcacctgccaccacgcccagctaatttttgtagttttggtagagatggtgtttcaccattttggccaggctggtcttaaactcctgaccttgtgatccacctgccttcgcctcccaaagtgctggtattacaggcatgagccactgtgcccagcctaaatgttttctttaaaagcaaggtaagtatgcctagatgcactgcctcttagtaatttttgaggatggattattcattaaattgcttccctttctcacagctggtgaattagaacgatagtgagcttacaagagctttaacgaggaaaagatggtcattgtttaacagagaaggatggtttgggtgagcatttttgtgtttttggaggggaactttgagggcaatgagtgttgcacctgtgtccactgaggatctctgggcggggtaaaaggaaggcagggatgagagtgaggaagggagacaggagggtcccaaatacgaactttgacttaacgaggatgattactagaagggaaagattgtggattcattgatgagatgttgaaccatgaaaactctaattgtagaactcacttcagactgaattgacttggctttcagtagcagaagccctttgtctacttctctagtattgaagtgaatgcaaatttctcaatgtaagaaaagtagagtggtgaaataagagtgtgggttccagggtcagacaactgggtgcataaaaagggtaaggatgctacaactggtaagccctgtgagaattatttaatccttccatgtctcattccgctcatctggaaaatgatgatcatactaacttatgagatgtgtgtacagactagatataatattaaaacatttctgatacctatgcattatattggatcaatatatatttgcaataaatgatcaactttttattaatgaagttagtacttatttcataacgagattgtttacttctaatttactagtattgtcattattactgttgctgttatactgctactgctgttgctactaactctttatgaagtacctaatatgctctaagccttgctctaggtgttgtatatgaagtatttctaaacctgaaaactatctaagatggctcagtctagcccattttatagacgaagactgaagccaagagagttgaaataatgagtaaagttgagatttgactttgtcttccaaacaactagaagcataaagcaatggaccaggttccaaagtgacagggaggggcattagtttggcccataggctgcagagcctgtgaccacagagccctatatattccagtggtgaattatgtttgggaatgtggcagaccatatggctatggcatcgttagacatgaggtggagagaggcagatgtgtggttactcgattgagttgagagatgccatggaaaggaggaagaagagcctgagagagcaacttcactcatggggagagaagcttatgtggagataagcttcacttcactaatggggagataagcttcacttatggggagacaagtaaggaagcagggatctccagaggatgtggagtatgcctggtactttcattgttctttttccttattcttctttattcttttcattattttacctaggttagatgttaaacacttcctgttgtttagtcaggcttccttttctaattataagactaaacactaagatttcatttgtagatataattattagagaattttgataaaatttccaagcagtgttccctctgtttatcatcgtgttccctgctgttattagttcacagtttggtctggaattactccagttaatcttggggtttcaggagagaaattgtgctcagggtacatgagaagagaaagtttagaaagcgaagggcttccctgtctagtttctagctcagaaaagcaaagatattctactttcatatgtatgataattggagctgagctgactttaaaaacagataatttttcttttttatccctaataaataatggtgcttacagcaatgagtgttgctggtaacagattccaccaatgggtgtggtgtgaagtttagcatttgtggattttgcagcttctgctattgtctacagcatttcctctcttgtctcggaggttcatactttctcaggcaaggacacttttaactccagataaatgtctgggttttctcactccaaggataagaaggtgggggtgatggagtggtggtggtagttgtggagttgtcttcctggcagggatttcattgtgggggaaagtctgtctttagaaaagaaatgtaaactgggcaagtagtctcatcagttaaatgatttccttgttgacataaggtgaggaaaagaagaacaacttttgggaaaagtaactgtgagaatacaagggaagaagaaaaataaggggttgaacattgaggaagacttatgagacagataaagtataaaggcaggtaatttgttctttcaatttggcatggggacagtaaaaattttttcttactaaacaaataaagcccatgtatttcttctgctctgggagcaccaattatattgagcctctaaataaagaaagtcaacatccacaagtgttctaaattccatctcgtagtgagagtcctgaaaattgcaatagctagagtcaatacttggagtatatgcataagacgtggtgtctcaaataggattaaggcctactcttggcatcttctgttattggtgttgtttctctgtattgattggtataacgttagacaaaactgcaggtcatctttgagaaaaactcagtataaacaatgaaaaaaatgtgtagctgcacatgtaatttgcatgtaacaaaaccaaaggatgctttagatagtaacagcagcctgtactttactccaacccattagttttatgataaatgtggtctggggaagtgctcgatctaggttgttcactttgtgtttttgtttctttctatcattcgggtgttgagtcacctgtttgtctgtgtcagtgtcagagcactgggtcacatcctgcattgtccaggttttattggtccctttcttaaattaaagctgattttccacttaaagagaattctgtctccttctgcaattgttcaaagtctagcatctcaagtgcagactctaaactgtatgtatatgtattgtgcaggctatctatcttcttagctttgaattctctagaaatattccagaggtgtgattcctctgttattcaagagtgatttccaaattgcctcagccaatgtgcctgcacaagttgtttgtaactcagggtgtaatgggaaatgctttagagccacatttgtggcttttgatgggaaaaaaaaaaaatcagtgtcctcctaagacttatacagtccttgaagccttttaggctattcctgcatctcatgttgcatccatacggactatttagccatattcaacaccatcctcttgctattttgttaagatttgactgttgttgttgttgtttttaaatataaatgtgtgatcacatgcacatacacagacaatgatgtgtaactcataaacatgaaaagtaaaaatttgaattttaactgaagaaaaatcagcattattcataaaaagctggtaagatattctaaaagtggaaattcatgcagaaaattgattcttaagcacttactaaatgccaggaatattttaccagcatattatcatttaatttttaaacaagtttgagagatagagatgtcttattttatagaagaggcaactggggttctgaaatgtgaaataacttgcaaaggctatggttaagggcagggccagccacgtgtctagtgtctctgacacctgagatcacacactgtatgctgggcttcaattaatttgcagctacttgttgcattaaattcacaatccttgctttcatcataataaaaacaataataatcatacaacacaactattttcagtgagctctggctaaggccatttgattcagagtcaaaaccttctatttgtatagtattttatattgtcaaaatctaataaggatagttttcatatctgacgtaaaccaaactgatctgtctccatttgatatagtgacatatcaaattgttactttcatatatcttagtcaacctctatgtttatcattctctatgttttagaaagtaaagaatttaaaattacttcagaaagatttcttcttcataaacataaaatgattagatgtcccttttaaaggcaacagcttcttctttttcttttttcttttctttttttttttttttttttttgagaaggagtctggctctgccgcccaggctggagtgcagtggcgccatctcgactcactgcaagctccacctcccgggtttaagccattctcctgcctcagcctcccgagtagctgggactgcaggcgcctgccactacgcctggctaatttttcgtatttttagtagagacggcgtttcaccgtgttagccaggatggtctggatctcctgacctcgtgatccgcccgccttggcctcccaaagtgctgggataacaggcgtgagccaccgcgcccggccaaggcaacagtttcttaatgagagagtagaaatgagaattcacattcataacaaagagtttattgtctttcctagtatactgtactatctagtagctaatctgtctaaagacatgtttcttatctattaatagtcctattaataatgtaaagtagctttagatatgccaagctgttactggctggggaactaaaaaagcttccagagttatatctagaaagtctttggggtttcttaatgttatgtgattagcaactaaaactgtgacaggaaggaagtccacatgaattgagcatctactagtttcaagatttatcattatgcacattacttataataactttgtgaagctgatattaactttacaatggataaaaagatagatgaattagtaatttacctccagtggtgcagacagcaggatttgaatttagtctgtccaacaccaaagcctccgtacttttcattaccctgcatccatctagtttaaaaaataaatgtactaggcatagtggcttgcacctgcaatcccagctgcttgggaggttgaggccagaggatcacttgagcccagaagttcaaggctgcagtgagttatgagcacacaactgcactccagcctgggtgatagacagaccccatctcaaaaaaaaaaaaaaaaaaaaaaaaagagagagagaaaataaaagaaaaatcgaatgtattgcatttcatgtctggaccacctgtatgagaaaattgggcactttctctctgaagtaactcatactaaaaacaaacaccttcttcctcccaggagcttcccaaggttgaagagaggaaccctgaagctctaatatgcctaagatgctctctggtgttatctaaaatcaaaatatatcacctagagcacttatttatttatttatttatttttgagatggagtctagctctatcacccaggctggagtgcaatggcatgatctcggctcactgcaacctccgcctcccaggttcaagccattctcctgcctcagcctctgggattataggtgcacgccaccatggccggctaatttttgtatttttagtagagatggggtttcaccatgttggtcaggctggtctcgaactcctgacctcgtgatccgcccaccttggcctcctgaagtgctgggattacaggcgtgagccaccacgcccggccagagcacttttttttcttaattttttatgatggaaaatttcaagcatacattaagtagagaaaatagtataatgaacaactgaatacttaaatctggcttcaataatttctaattttatgttctgtctaatgttgacataaagtatagtttgtatgtatttggtggtgagtacataatgggccacatgatttttaccttttaggctgtagttctacatcagtataagatggttgtttttttcttccaatacaaaatctaaagcgttgtcggcagtgacatttttaaaaacacaatatgagacgcaacaataaatcagttattaaaataagataaagtaggtatataaatatttcaccttggaaataaagcaaagtcagtggaagagtgtgaagactgtgaagattaggagcatgaaaataaacgactattgggagccattctattcccatgagtgaatgtgtattggttccattcaatgtagggaagagcagtaaaagggaataaccataaggataagaccactggattatctgagagccacagttgtcctttgccacatggagcatctgccctaggtattacagctctgtgagaaacagaggttcaaggaaagaaatttgttatttttcaattatctgcataaattctttggaacaggggcatggattataaaagatgtaagataataaaaagcatttgtatttgactttggaatgtattgtacttacatttgtctagaggtgtgtctattctggctattctctttaaaggagccattctatcgtgaacagatcctgttggagctgttttcttgttctaccaaccttcagccacctctctgtctttcatattacttattggcagggtttcaaaaggttttagtccttacttaatataaacaaaaatgtacaatattgacaaagtttcagttaagcagatgaaattctaagagttaagctgggattttccaaaataatcctgttaacagacttgaaagcacttatcagttctgtctaatgaagacattagaacaccataacctttccggcccattttctttgtcaataagcgttcttgccctgtcagcagctcacctccagctttagttttctcatgacagtaagtctattaccctcctgatctgtcttctggctcctcctacccaggatggggaaggtttttgactttactgatattctcagaacaaattttgggaagtaaatataaggttttccagtcgggtgcagtggctcacgcctatgatcccagcgctttgggaaaccaaggtgggtggatcacctgaggtcaggagtttgagaccagcttggccaataaggtgaaaccccatctctacaaaaattagttgggcgtggtggcggcacctgtaaatccagctactcaggaggctgaggcaagaggattgcttgaatctgggagccggaggttgaagtgaactgagattgggccactgcattctagcctgggcgacaagagtgaagctccatctcaaaaaaaaaaaaaaagatgaggttttccttaagagcactaacctagtatactgcacaggtgcctgtattcatgcatcccacacagaaagagaaaatacttgtctgaacttgtccataaattcagaatcctgccccttaacttgtatgccaggtttctggcatactcttatctgaaaactcactctattagaaaagcaaagcacagtgattttcccatcctgattacctggcactgttttttatttcagtgcttctgtttctttgccatgtaaatgcctgtgatttgccaggtcatttgtcctgattttagttgaaacagtgcagtcatcatacttgcagaatgatacaaaataatataaaatatattgcctttgtactaaacagaagtgcctctctgttggtgaaataatacatataaacaaaaataataattagtgatacttattgtgtgttcactatctactagcactgtattgagtgctttacctgcattgcttcattttctcctcacaatatccctattaggtaaattcagt

SEQ ID NO: 436 - DNA, 201 bp, Homo sapiens
gtgcttgaagtttctccagtgagcaagtctactcaccaggattggcttcaggatgtccatgttggaacgaagtactcgctctgctgcagccagtttctccyttggtaggccacaaagctcagaaacttcttggtcaccaagttgaatcatctcttctgattttgatccattgcacagacttgtcaaatgtaactggtagcc

SEQ ID NO: 437 - DNA, 201 bp, Homo sapiens
gacaaagaacactcgcaaagtcagctggcgtgactgggagtagaacccccatctccatggtcccaatccaagcctcttcctcacacctgcggttagattgraatttagctcatctcaaacccctctggtactctcctccatctgccaaacatttgtcagtttcacctcctctgccagctacaaagctcctcaagggcacct

SEQ ID NO: 438 - DNA, 201 bp, Homo sapiens
cgatagcagatgttatgaaaacttaacacagctccttcagtaaatgccttcaggtcattggaagctgtcgcggggaagccattggtgtttccttgtgacaytgggataaaaacttcgacattactggaagacatctggagagtttttatctttctgcagacagaaaagcaatagtaagttgatagtccagataaatgagat

SEQ ID NO: 439 - DNA, 201 bp, Homo sapiens
ccctgggcaatagttctaccctctacaaccaaggaggagccagtcgctgaaccatctttgaagccattggtccttcatttcatcctgtctctgtccctttyagtccatgctgtcaatgtttctgctggtataaaattctcaaaaaccttattggcctcccatgcaagtcatgggggtccaagcagtcagacaagagggcac

SEQ ID NO: 440 - DNA, 201 bp, Homo sapiens
cttccaaatgatagctcctcattaaaactagctaaaatggatgatagagcttgggataggttcaccacttatatcctagaccagtactttctaggatggastttatatggaagaccaaaggtttactccttgggctgtcaaccttcattttacttagctcttcaaacaagtcaagccttgtttttagctcagctcctgggg

SEQ ID NO: 441 - DNA, 201 bp, Homo sapiens
aggtttactccttgggctgtcaaccttcattttacttagctcttcaaacaagtcaagccttgtttttagctcagctcctggggaattgttctgttgacaaygtactgcagaaaacagtccaaacaattcttaagagctaagagccacctttggtgactagactttgtaaccatctcatttatccaaggtggatctacatct

SEQ ID NO: 442 - DNA, 201 bp, Homo sapiens
cagggggtgttaaagaggtctagctggagccagccagatcccccacataaggaagctcttcatttcagaaacccttcagagacccctgcaaacctcacacktatgcacccgacgcagaggtgagcacctggacttcagcctcacagcactaatcagtgggaagcagggatttgccaatgacagggaaagccccttgcataa

SEQ ID NO: 443 - DNA, 201 bp, Homo sapiens
aattcctgaatgcctgcagagaccctaggagaaaggctcattttctttttttctctctctctcttccccgccacccttattttattttcattttatcctcygttcttcatacgggctttggtcctactttacagcatgtgtggctcttcataacctattgagaaagttaaagagttttctgaaattttcttatggttcata

SEQ ID NO: 444 - DNA, 201 bp, Homo sapiens
ctttggtcctactttacagcatgtgtggctcttcataacctattgagaaagttaaagagttttctgaaattttcttatggttcatatattaagttatttcyggagctctgcttttcccatgagattcgagaatgtcattgctttcccattattccaatctgcgtatttttacaagcactgtgctgagaatgcactattttc

SEQ ID NO: 445 - DNA, 201 bp, Homo sapiens
ctgacaacagagagtatgtcttgcccttggtgcctgagaatgtccacttgggtgttggtcaaatcagcttcttagacctgcatctggacagaaaaggcttrtgtatataatctgtctcaatccccagtatttattattctgagttttttgttctcctacccccaacagctggttctcagacattctgggagtacatgaaga

SEQ ID NO: 446 - DNA, 201 bp, Homo sapiens
agacctgcatctggacagaaaaggcttgtgtatataatctgtctcaatccccagtatttattattctgagttttttgttctcctacccccaacagctggtyctcagacattctgggagtacatgaagaactagaattccccatgtgctattaaccttgccccaccctgaagtcatgttttatgtggttatgatccttcccc

SEQ ID NO: 447 - DNA, 201 bp, Homo sapiens
attggcattaccattaaactaatactactctttagtatatgtaaaatgcataggacagtaactcacacagagaatgtactgtggcttcagctgtcattacyttagcaaaattttggctgatgtcaccagtgacttctcctttgctgaatttatggaatgctctgtagacctcttctcaattgacatttcagcaatttgata

SEQ ID NO: 448 - DNA, 201 bp, Homo sapiens
ccattaaactaatactactctttagtatatgtaaaatgcataggacagtaactcacacagagaatgtactgtggcttcagctgtcattactttagcaaaaytttggctgatgtcaccagtgacttctcctttgctgaatttatggaatgctctgtagacctcttctcaattgacatttcagcaatttgatactaaaacaaa

SEQ ID NO: 449 - DNA, 201 bp, Homo sapiens
cttcccttttgcttgctagctccagacacagtgatcttctctgattgtcaaaagcaataagcttcatccaccttcaaagctttcactttctttgtgccacmaacaaatcccacctctcccccagtcatgtctcgcaccagtgttagtttcaaatcctgctcctctttcaggcctcaacttaactctttttctcggggaagc

SEQ ID NO: 450 - DNA, 201 bp, Homo sapiens
tctctgctgtgataatgaaactgtaatctcttcttctcacagtccttaggaatactcttccaagtctcagctagcagagtcgagaaatagcatgacatagrgcaggtgtaactgtcatagaagggcattgtgtgggtgccacaatcatctaagtctaccagcagtatatgaccagaagcattacaggaacagcatggctgg

SEQ ID NO: 451 - DNA, 201 bp, Homo sapiens
aactgtcatagaagggcattgtgtgggtgccacaatcatctaagtctaccagcagtatatgaccagaagcattacaggaacagcatggctggaatagcagyacacatagctgggctactgaaggtgtcaaacagagcctgttacaggtgtcatcaattgatggacatttggtttgtttctttttggctaaagatggaagtt

SEQ ID NO: 452 - DNA, 201 bp, Homo sapiens
agggatttcaagccactgagagggtctgattgaattcgaaaaccacagtatgatgctgcacagtcatgtaatttatgacacacaaaactcttcaacagtargctctgcctcttctcagaacgccacacatcagctctgctaaactgcttgtagttccacgaactcacctctgggatttgcagtgttcttctctttgcctag

SEQ ID NO: 453 - DNA, 201 bp, Homo sapiens
actcttgaatgatggtttctagaacacaactggaaagaggcaagagtctatttacccagttgcacacaggtagaaaagaataagttaccagccaggattcycagtgtaatctagcattagagataacccctgatagacatcagaagagggtgtaagtcccttttcaaaagaaaaaattaaaaactactagtgatatgcctt

SEQ ID NO: 454 - DNA, 201 bp, Homo sapiens
caggaattcattctgggaggcattcacaatttgcctctttctccagggatgggcggagggacttgtaaccttgaaaacattcttgcatgtgagaagtacaraaaaatattatatatttctgcataaggagaagcagtagaaagtttttgtttgttctgtttgcttttttttaatctaacataaattgactatgccaaaaac

SEQ ID NO: 455 - DNA, 201 bp, Homo sapiens
tctgtgctttctacataaaaagtgcaaaattgttttaccaccaaccccagaatgaattttcgcctgcaagaagaggggggatctcaccctcattgataacrcaggttctcaggtatagatccccaggtttcctgccaaaaatgaggtacatgtgtaggtaatgtttattattattattattattattattattattattat

SEQ ID NO: 456 - DNA, 201 bp, Homo sapiens
ccaactgcaagccaaggagagaggactcagaggaaccaaacctgctgacaccttgatcttggacttctagccaccagaactttgagaaaataaattaatawtgtttaagccaccagtcagtggactgacattttgctatgtcagtaacagcaaattaatacgaactgtgtacaaacgatggatgaattttggaggatgata

SEQ ID NO: 457 - DNA, 201 bp, Homo sapiens; identical to SEQ ID NO: 163

SEQ ID NO: 458 - DNA, 201 bp, Homo sapiens
ttgttatgctgtctggcttgttctgaggtcaacagggaagtcaactagtactcagtcattcaaataaggagaataatgtactcagacttaacattgttctsgtattcagtcctaccaaaacatcatttctgccacttactcaggaaagagtaaaagctctaactcttaatttaatttacctttctccttcctatacgatac

SEQ ID NO: 459 - DNA, 201 bp, Homo sapiens
ccaaaaaaacactgattaagcaactattcatgaagaagaatgcctttgtgagatttagggaacccaagaaaaaggttgcagcacaccaatggtgcaaaatrtctgagaaaagctgcatttaaaaggataaaatgagtagtttccctctatcagatttacacttcccctaagctaccacagcacagtaccaagaaagatccc

SEQ ID NO: 460 - DNA, 201 bp, Homo sapiens
tatccaacatatgccaaaaaggcacagttaaaaaatgccctggcagtttctggagagagattctatgccatgctgataggtagcaccaaactaaagccagyactgggcgctggggagagggagacccatgacaagaggaagttctgtttgacttctggagaaacagaaactatagtggctgagactggcagttcctcatca

SEQ ID NO: 461 - DNA, 201 bp, Homo sapiens
caatacaaagggaccaacatcaagtgctagcattgtctttccagtggggatgatgaaattgttagctctttagggagctccatgagggcccacccttgcaytgtcctgtcctcttctcccttaacgccatggcaacaagcagtccacccaaaagtctctgcttctgataaacccagaccatcttccatggcatttactcat

SEQ ID NO: 462 - DNA, 201 bp, Homo sapiens
gctgcttccctatttccctactcacagctgagtgccttcaaagagttgtctgcattgtctctactctcacaccgcaaaggcttagagacaaggtggtatartggttgagatagtggattcatgagccagactgcctaagcctgtattctgcttctgccatatgaactgggccaagtcacttaacctctctgtgccttggtt

SEQ ID NO: 463 - DNA, 201 bp, Homo sapiens
tcttcttggaccagcccctgtacatctagctgcttccctatttccctactcacagctgagtgccttcaaagagttgtctgcattgtctctactctcacacmgcaaaggcttagagacaaggtggtatagtggttgagatagtggattcatgagccagactgcctaagcctgtattctgcttctgccatatgaactgggcca

SEQ ID NO: 464 - DNA, 201 bp, Homo sapiens
tagtaggaatatagtatttattggatgaatgaatgaatgaatgaacaaacgagcatgggaagcagtgtgtgtcagtaaaagagcatgttttagagtcaggyagatctggaatcaaatgttggctacaccatttatgagttctacactacctttgacaagtgaacccctctgttccttcatttcgtcatgtataaaatgaag

SEQ ID NO: 465 - DNA, 201 bp, Homo sapiens
ccctctgttccttcatttcgtcatgtataaaatgaagaagataactactacattaggattgctgtgagaattaaatatgataacagtgggaaatgtctagyataaactcagcatatattaggagctcagtaaatggtagctattattattgttattccatatttctgcacatccagttaatgatagaggaagcagcataaa

SEQ ID NO: 466 - DNA, 201 bp, Homo sapiens
ctcagacattctgggagtacatgaagaactagaattccccatgtgctattaaccttgccccaccctgaagtcatgttttatgtggttatgatccttccccyactccccagcttccctacagccatgcctacaccactgcttcttttccccatagtctgcccaaatcaccagtgtgatgctgcttgtgctcttgatgctact

SEQ ID NO: 467 - DNA, 201 bp, Homo sapiens
tttaaaattagttacatttaaatgtaattaaatgctaaaaatctctcttccttccgtctctctgtctctctctttctcccacacacattcactctatatgycccccatttctgaaagcaaaattgatagaaatatagaatgcatctagcagcattaccatattagtttcctaactcatggagctgggacttttaagtagga

SEQ ID NO: 468 - DNA, 201 bp, Homo sapiens
tcaaaaaaaaatattgtgggaatattttaaagaagagaaccacatagtcagaattatgtttttaaagccatactctgacattgcaggatgctgatatctaygaataagtggattctactgagaaaatatctgaaaagcaggtgaataacattaaaatcctaggttattgtttttcaagcttccttttgttaaatttcagag

SEQ ID NO: 469 - DNA, 201 bp, Homo sapiens
tctagggtttggcagacacctccctcaccctcacccgtgcaaacccagctcttcatcctctttcatgtcttgcagtggtaacagtgcccttagtggactgygctgtacctttactttttcttctccttggccatgtgaatgaatgctgtcctttacccttctacttatcaacccctagtcacatttaaaaacccagttcta

SEQ ID NO: 470 - DNA, 201 bp, Homo sapiens
tacttcggatgtcatttctatctcccttgaagaggagaaacatctcatccagctaacactgttcagtggccccaagggcagatccacgttgattctcttcrtgccctcactaatgctgcgttttcctgtattcttcgaacatttgacttatttgggaagcctagaagctttgccaaagattaggatcagccagagattggt

SEQ ID NO: 471 - DNA, 201 bp, Homo sapiens
gccaaagacccatcacatcaggccaagtgccttctataaacatgttccccttattctccctttgccacacaaagtgtctagccacacatgctaaacttaarccaaagatatgtaaagaatgttagaaaatgtattataaagaaatagttaatatgaatacaaggtgaaacagtgctatttgcctatcagacaaagacaggt

SEQ ID NO: 472 - DNA, 201 bp, Homo sapiens
gtgggctgcccacatgcacagtggcctgccagcacttggcaggggccgcatgcgcagtgtgtttaccggagttgcgcgcatgctcacttgaggcatccccscttaccagttgaatgctcctggaaagtcatataacaattaaactccaccatttttcctcttagtgtgcatgactgagcccactcacccaactcctgagat

SEQ ID NO: 473 - DNA, 201 bp, Homo sapiens
aggccccaaaatcttaagtgaccctccagaacaggtgatggcagagccagtgccttctaactgatgttcagtccagtctccaaatttcccctttgtataasaataccagttgtatttgattagggcccaccctgatgacctcatttgtaaatacttatctccaagtaaagtcacattctgactttaaaaccacatcctggg

SEQ ID NO: 474 - DNA, 201 bp, Homo sapiens
cattctgactttaaaaccacatcctgggggttaggatttcagcatatgaatttggaagtgggggacagagttcagctcataatacttcactctctccccamcagaatacatgtccttcacccaatgaaaatattccatcccaacaaccccaaacgtctttcagacatcaactctcaagtccaaaatctcatcttaaatatc

SEQ ID NO: 475 - DNA, 201 bp, Homo sapiens
agactctaaacagggactccttcgatctccccctacaaacatcatttctgcacccatcctctcttcacctcctgagacaataggaaaagggcctctatgtytttcagcaagcaatccttccttctggactctggcctcatacccttctacctctcctgggaccccattcatgcccatcacttcattctcctgtaagttcag

SEQ ID NO: 476 - DNA, 201 bp, Homo sapiens
gaatgtagatccccatgtcttgatgagaaactatcaatgttacattgtaaaaagaatatatgtgattatgaaatattggtggctagatttggaaactacamtctgtcacacacatccaaaacaataaactgaaagctgactttgaaattaagataataaggttatagagtacaaatatatgcaaatccatagttttattat

SEQ ID NO: 477 - DNA, 201 bp, Homo sapiens
cttccctcacgaaccttaccctggaaggcagaagtctagatctttgaagttagatgctccttgtttagttcccgtcttcctcgggtctttgagcaaattayttatcctctcttagcctcattgttaccacctttaaaatgggaaagaatgcctgcctcacagagttgtgaggattaatgagcccatagggatgctcaggaa

SEQ ID NO: 478 - DNA, 201 bp, Homo sapiens
atctagaccagcttctcccactaggtcccaggcacaaactccagttttaagtccttcccttcctgatatgtctctatccacacattcgtctgttcaggctrgtggatggcgaaaactcccacctaatctcagtcccactatagagtataatgatggaagaccagcaaagcgccatgatattgcacggtctcattctgaaag

SEQ ID NO: 479 - DNA, 201 bp, Homo sapiens
gtctcaaaacaaaaaaaaaatcaatcaataaataaaaataaagaaataaaataaaaaataaaaataaagaaataaaagatttaagcatcatagcataccaytggtgccttgtcaagcatcaattcatgccatcttttgtagggtggtaagtcaagatttatggtgtaccatggaactgcacctctgtacctgtaatgagag

SEQ ID NO: 480 - DNA, 201 bp, Homo sapiens
agagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgaggtaagtgggagtaagagtttggtggaaaggcccaagatttctgggga

SEQ ID NO: 481 - DNA, 201 bp, Homo sapiens
aaacaggtgaaaacacaaaagtccacaatccagcacaggtgatctcatctttcccccacccccaccagggttcctctacgtgctggcaggggtgagattgrgtgacttctctggccaagtcttatcaatatttttcaactaatgaatggctcccaggtgatgatactttcagcttctgagaacagcttctcctctgaggct

SEQ ID NO: 482 - DNA, 201 bp, Homo sapiens
gcttcctctgaaagccagcaacagccggtgctgtcacacccaagaagtacaggtacctcagtccaaacatcaggtctcgaatattcttctgtggtcaaaastggcattcaacaagttgctggtctgtgtgggctccaattattagcacagacaactgttaccactggatatctcgctgcctatgcccactaccacagccca

SEQ ID NO: 483 - DNA, 201 bp, Homo sapiens
ttccttagcatgtgggtcagtggctcctgatgttctgtctgcttcgctggtattctctaagcagggaggggaatggttttgatgataagtgtaagtcaaaratgaaagtacaactcttggcctgatcccaaccatagccctctctttgcttcccatgccatgggccatggatggaacttccttatatatttatgtaaataa

SEQ ID NO: 484 - DNA, 201 bp, Homo sapiens
ctgacctatgtctatcgtagacctaattccaagcgtgcttgacttttttatgctaacatcctcttatgcctttcttcttccccaccaggatgtaacagtcyctcccaagcctgtctcgctccatcctttatatcagactaaactctatcctcctgctaagtcactgctgcatccacagaccctctcacatgctgactgtct

SEQ ID NO: 485 - DNA, 201 bp, Homo sapiens
acaaacttcaaaatacttaaacacatacatattttaataaattatgagtttcactaataaatgccatgtttatgttttgcaggcaaatctctcctcaccawcttctacagtatctgagagtcagctggtatgtatcttctaagtcacagatctactgcaaattctgatctctcaagagagctttacctgagtaaaagtgaa

SEQ ID NO: 486 - DNA, 201 bp, Homo sapiens
atatttttttcttggaatattaatacatacaaggctttctttgaagatacttttctactccagttgtatgactagaagcctcatataagaactatttcatytgtcactaggcactagatgaaccagccaagactgaaagtgtctccaaggacaacacattagaaccaccagtggaggtaataacttcagattacccctgct

SEQ ID NO: 487 - DNA, 201 bp, Homo sapiens
cttggtttaatcctttaagaaattatttcaaagtggcaaatatatatatgtgtatatatatatataatgattttataaaataagatatagtaaaacaactmtttgtgaatgtaataaaaaaaacttactttttgcccaataaaataatcctgttgtttgtgttctctagtggcaaaactacaaagcattgctttgaatgac

SEQ ID NO: 488 - DNA, 201 bp, Homo sapiens
aaagcatcttattattatgtcatgattcccaatgaaggaatttgggggatttatagagattggataaaaagatatttagattttttcctaatttaattaayatgtttgagccttttctctcttttccccatgataataatttggaattatttagtacaatatactaaaaaatattagtaatacaaattgtaaagtgaaact

SEQ ID NO: 489 - DNA, 201 bp, Homo sapiens
acattgtggtttacatttaattttgcactttctctgggaagtttctgatagcagtgatacggagttcataatactggatgaaataaaaatgtctgggggtrtctaaagcatcttattattatgtcatgattcccaatgaaggaatttgggggatttatagagattggataaaaagatatttagattttttcctaatttaat

SEQ ID NO: 490 - DNA, 201 bp, Homo sapiens
aaggcatttgaaattcatccatattattgcatggatcagtagctcttttttttttaattgctgattagtagtccactgtgtggatgttccatcctttattwatctgttcaccagttaatagatggctgggttatttctaattcggagctattactaataaagctgccaagaacatttgtaaacaagactttgtatggatat

SEQ ID NO: 491 - DNA, 201 bp, Homo sapiens
gacatgacttgatgtagaactgacggacatcatttaggagatgagtgacatgactcgacttatactgtggttatcttatgatttattcaacaggattgtgmaccctctgaaaacagggggtatgtcttttttttatctctatagacactatagttcctgacacagactagatcttaactggcaaaatgtctccagtgaaca

SEQ ID NO: 492 - DNA, 201 bp, Homo sapiens
ttgaaggatgcagtaatggctaaagcccatctctctctttctctcattattttttcttatatgattaaaacaatgtcaaaggctgtagaatatggattacraatttttatttcacacaagagccattcttatactcatctcaaatgttactcttcccagttggtgtaaaactggagcgatatgaatgatcaaaattttaat

SEQ ID NO: 493 - DNA, 201 bp, Homo sapiens
tgagtacccaccacaacttttagaactcagtactgcttgcctacagaagccatcacggatgccttaaaaagggtggtgatgggaggttaaaagtcttcccrtagaagagttgacagctgctccttaagagtttgcagctgccaaagctgataaatagattcaggtaaggatgctgagacaaccagaaagagctgggaacca

SEQ ID NO: 494 - DNA, 201 bp, Homo sapiens
gtggacacatgttgtcacttctcttgtgtatatacctagcagtggaattttggggtaatattgtaattctatgtatagcattttgaggaattgccacactsttgtctaaagtggctgtgcccctttatgatttcaggagtaatgtaagagggtttcagtttcctcacatccttgccaatgcttgttattgtttgtgtttta

SEQ ID NO: 495 - DNA, 201 bp, Homo sapiens
ccacagatggggctaggggtgggggatggtttctggatgaaactgtgccacctcagatcatcaggcattcgttagattctcgtaaggagcatgaaacctgkattccttacatgcgcagttcacaataagattcacgctctgatgagaatctaatgctgctgctgatctgacaggtggtggagctcaggtggtaatgctcgc

SEQ ID NO: 496 - DNA, 201 bp, Homo sapiens
aatttattttttattcaaaaaatttttccacctctaacttcgttgtgaagactatttagtacagcaaatgttatggacagtttaaaggattggggccaacrttaactgaccaagaacaacttccatctaaatcatcacaaaaaatgtttaaataaagaaagaaaaaagtaaaagtaaaaaagggggacaacaggagcttca

SEQ ID NO: 497 - DNA, 201 bp, Homo sapiens
tcattctttgtacacacctgtgaagcccaccctcatttctctagtgctcccaactcaattacatcctagtctgttgggactgctgactcaggagcatataraactctttaatcctatctttgttgtaaggctggcatgtctgggtattagctcgctaaaccaggcagctgaggtctgccagatcgtccataaaatcaaaca

SEQ ID NO: 498 - DNA, 201 bp, Homo sapiens
atatttcaaacatgagaagaaaaatcaattaacatggacttaaaaggacatttccacctctttgaaaaccatctattaaatcatgtggaatatcttagtcrttgattctgctagatgacaataaagctaatttttgtgggaaatggtagagaggtgcaagaaaggaggaaagtattttgtaacaatatgtttcaatttggt

SEQ ID NO: 499 - DNA, 201 bp, Homo sapiens
gatgattaggataatgttctccaaataactgagacaacccttaagcattatgagtaattaaaaaattctggtcttaccccaggtgaagtatagtagtaaayagtaaccgtgaatcctgatcatttggcagaccaaagtgaaaaactaagtagttgaaaaacttaaatctcttttgaataagaaataattccatcttaattt

SEQ ID NO: 500 - DNA, 201 bp, Homo sapiens
ttcagtgttcctaaaaagcttctttaaattacagtgcctggttgaggaggcacttataattagagtcaatgggcaaaaaatgacttagaattactgtgggyatctgcaaaataatattcacattttactttaaaatgtacctgtctgcttcactgtgtatagtaacgcgatgtgtaaaaaataatgaagtgtttcgtacct

SEQ ID NO: 501 - DNA, 201 bp, Homo sapiens
ttatcttgctgactcaatgagattgtgtcagagaggaatgcaaggccatctgattttggtgctttactccttatccgagagcagatttatggaagccttgrgtgcttacatccttctgcctgtaccaccttggctaccagcagactgcaggctcctcaaggtcaggaactctatgttcttggcaccttgtaagcctgatac

SEQ ID NO: 502 - DNA, 201 bp, Homo sapiens
ctaataggcacgtgctggcatctcatcatggcttgaacttgcatccctcgtggccaataatgttgagcatcttttcatgtgcagactttccatttgtatakcattgcttaagtacctattcaaggatttttgtcattggcaaagtattttgctgtcgattagtttaggccagtgtttttttcatcagcccacaattggcat

SEQ ID NO: 503 - DNA, 201 bp, Homo sapiens
agtttctgagattattttttctagacagtcatcttcagatgatttgatatcaggctgaagaccatgtgtcttctgggtcactcttactcctaggggctcartctgtttttggcaagtcctggttgactttctctctctatacctgtgagatatcaaaagtttgggttagcttctcaagcaactcatcattatttgcaaaca

SEQ ID NO: 504 - DNA, 201 bp, Homo sapiens
ctccctaggtcatgtaccaccctagtctactggctctgagctcagtgcagtactaggagttgcctaggaattgcagtccttatgtcctagactttcctccrtttgcctagaatcccagagcacttttgcctatggtggtgagcctttccaagagagtcaacttccagctgctgggatgggcagttcccctctgtataggcc

SEQ ID NO: 505 - DNA, 201 bp, Homo sapiens
taaaccttcacaaagctttcctagctgttgagctgaatcatcacaaagatattaacaaaggccagcggggtctttttccctgcataagataacacacaagwtaggcaccccaaggtagctaaaccctggtcttctttggcagtaggggagcctggtttagatgacatttgccttttgcttttgaaatttcatgccgttaca

SEQ ID NO: 506 - DNA, 201 bp, Homo sapiens
aagatctgtctgataaggtgatgtttaaacggacatttgaaaaactgaaaaagaaggaataagggagttccagacaagggaagagcaaatacaaactcctrgaggaggcagtatcatataatgtgtaagctagagtagaaacagtgaaggggtggaagggagagtactaggaaataagattggaaaaagagaggctggtta

SEQ ID NO: 507 - DNA, 201 bp, Homo sapiens
ggaaactactgcatgctataaagtattcacacagctgctgaagctcagtggcatccaaaaaatgaggccaaccacggggacaccagtcttgagttcgaagyccaactgtgtcatctgttagttatgctaacttgggcaaatattcagttttgctgcctttaaaatgggggaaaatatggagcctgcatgtctgtgagggat

SEQ ID NO: 508 - DNA, 201 bp, Homo sapiens
ggcagggaatgaaaggaatttttgaaagagacacacaatatacactgaaagcagttgtctcatgagggacaccatctcatgaggagaggttgtcttcttastggtaagagattctgacctatgtctatcgtagacctaattccaagcgtgcttgacttttttatgctaacatcctcttatgcctttcttcttccccaccag

SEQ ID NO: 509 - DNA, 201 bp, Homo sapiens
ttctgctgttacaaggcagcactgagttcaatgtaatgtcccccagttgctgtgctcttcctttcccaagtgcacagactctctgtgctgcatggtcactrctggggagtagggggaagggtgacattaacaattcaagactgtctctccaacccccttcaatgcctctttcagcaatatgaagttaaaactaggtactat

SEQ ID NO: 510 - DNA, 201 bp, Homo sapiens
tttttttttttgtaagtgaactggtcacaggaagagaggaagattaaaaaaagtgaaagtattaaaatggcttataatattaaataatatgagataagagktaaagccagaataaagctgatgaaggtcagtgatttggaagtcccaatgatgtggatgttgcactagtagcactagagaaatgaagatggtggataggag

SEQ ID NO: 511 - DNA, 201 bp, Homo sapiens
ttattgataagtagggacttacccctgcccttttgttattagttttctggttgttttgtggtatcctcttttttcttttcctttttcctgtctttcttttygtgaatgtgattttctctggttgtatgctttaattttttgcttttttattttttgtgtatctgttgtatggtttttaatttgaggttaccatgaggcttg

SEQ ID NO: 512 - DNA, 201 bp, Homo sapiens
tcagcgtgtgggaaatacttccaggccagggactcacccttcaggcaatgggctcccttctggcccagggctggtccagaaatgatgtctaagagcctatkcctggattcagggacctcaaaagcctgtttgttgctctacctccctgtgatcaagctggtacctaaggtgcaagacaaagttccctttacttttccctat

SEQ ID NO: 513 - DNA, 201 bp, Homo sapiens
gtagagaccaaaatttcatgttaagtttctcagtaagcatccgtcagctggaaggcaactggagggaattcggaaccaggattctctgagtttctgaacastgtgtcactcctgaatttttagtaaaattaattaatttttccctttcttagggaggtaagacatttccgagatgtcaataagaggattatatggttgatc

SEQ ID NO: 514 - DNA, 201 bp, Homo sapiens
ttcattaataatgtttatgttctaactttatgtatgattagaaatccgtgtgaataaaccaggtaatttattttcaatcatcatagaaataaacagctttrctctcaattctaaaacttttctgacaagtttttaaagataatggagattagatagctatcgagatgattaaaatataaaatatttgagattgttggaatt

SEQ ID NO: 515 - DNA, 201 bp, Homo sapiens
ttctttgcagttgcactcctctatttgttgcaccaccagtttctctccaaaacaacacattgcctagaattgaagaccttattcattctttccagacccayccttccctgattccttatccatgacaaactcaactccgaaacttattgtgtcatgaactaaaccttgtacttctgcccctccactcactttaatattttc

SEQ ID NO: 516 - DNA, 201 bp, Homo sapiens
agagttttattgcatatcaccatgaacagagggagaaaaacaacaatttattttaaatgaagaagattaaaatcgtgtaaagtccctaaagaagtggcctytttccttgactttctgaagatgagaactttggctttctactctttcttctgagggtgaaactcaccaacccactttccttcttctcatcctctattggaa

SEQ ID NO: 517 - DNA, 201 bp, Homo sapiens
ttgtgttaaatagatgccaatagggaagtttgggatcactaataagggatttacaggaagaggtaaaatgaaggactgattctgagctactgactgagaawttgacaggtgcccatgtattctttctgcatacatattttcatgcctttacttcctctttttaaaaatttattaattagagaaactcaggaaaatcaatct

SEQ ID NO: 518 - DNA, 201 bp, Homo sapiens
ttctgggagtgaatgattgaattggagtagatgagaacatctttgtaattgaggagctcaaaaaatggaaaagacagagatttctacatgaattttgaaayaggcaaaaattatggaagaaacatgaggaaagaactattatgatccatgagttgacatcatcaataaataaggagaaattaccagaaagctgataaagtc

SEQ ID NO: 519 - DNA, 201 bp, Homo sapiens
atgtgcataatttaaaaaaattatcaaattgtatttaattatgcatatttattgctttctttctctatcttgaacttcttgaagaggcagatatactataktctttactaaatgttcattaaataaataagtttagtttggggccagataggtctctaaaatttccaattttattccacaggctcttaaggcaaatttttg

SEQ ID NO: 520 - DNA, 201 bp, Homo sapiens
aaagaaaaaactcagagcattgcctatgttttattccagggtatagaattgtgagcagtaaaaccaatcaactagtgtttggtgcacaactgctaggataygatgagacctattctcaagcagcttgcagtcttttggggaaatgtctttggggaaatgaggaacacacacacacacacacacacacatatatatatatac

SEQ ID NO: 521 - DNA, 201 bp, Homo sapiens
aagtttatatttttgccttgagttttaactaataattgcattatggcatcatacttgataagacattaacaaaaccggcatccaaggtcatgaagctgtgmaattttcagtactgtttaaagacacaaggtactcaatattataatgtgtaaagttttactgaagcaaatgataaaattctcttttgaagaatcttaacag

SEQ ID NO: 522 - DNA, 201 bp, Homo sapiens
ttgctttgaaatgtacttattttccctctacacgttttaaaaatttcattttaggatatttctgaaatcatttcctgctgacctgattttacattagacayctttgtgataaaaaaggtaatagcatatggaaacatacattctattccttcaccatctgagtgacagtgcgaagagggatcagactagagaatcatttgt

SEQ ID NO: 523 - DNA, 201 bp, Homo sapiens
aagcatcatggaaccaatgaattatccaagtaaaagaggaactgaaactcatctatttagggcccagactttaaagatgaaaacctaaagcccagacacaragtgattttccccaggtcacaaagggaattaattagatagacaaacttgggaacctttgggcattaccacaaatatatgctctacttttgaattctaaaa

SEQ ID NO: 524 - DNA, 201 bp, Homo sapiens
aaaatctcagcatgggtgggaagataaagcaagggttagtttagaagtcctattttggttatagctccaggattgcctagggatttgtgccaatcccattrctttctcaagttggttgtatattttttaaaccattgccctttaaaagtctttgctttgaaatgtacttattttccctctacacgttttaaaaatttcatt

SEQ ID NO: 525 - DNA, 201 bp, Homo sapiens
cttacaaaatgatttatggctagtccagaaagcactttcggattgctctattggaaatcaggagacaactgtgacccattactcctgtgcatccgcacagrcacacttattccctctgctactggccctgtgacccaccaggctaaaggctgtattggaacataggcacacctatttctttgcatattttctttgactgct

SEQ ID NO: 526 - DNA, 201 bp, Homo sapiens
cccaggtgactttggtattacttctatcccagtttttcagatcaagagacaaagcactgagaaattaaatgacttgcccaaagacatgcacagctagttgrcaccagagatggcatttatccacaaaactctggttctagcacacaacacataacaattccatatggctgctacactgggtagatgggaggttgggactat

SEQ ID NO: 527 - DNA, 201 bp, Homo sapiens
ttgcagaagtaaacagtaggagacccaggagtgagagacctcttctacttctgagagaatacttttatattttcgtgtcgtgtgtttttagttttctctgygatactgaaaaatccccaatcttctatatgcagaaaaatgctaaaacccatctctagaagcttgccagcaagaatgcctttatttccacagctattatcc

SEQ ID NO: 528 - DNA, 201 bp, Homo sapiens
gcattttatatgtattcactcatttactcctcacaatagcccaggtgactttggtattacttctatcccagtttttcagatcaagagacaaagcactgagraattaaatgacttgcccaaagacatgcacagctagttggcaccagagatggcatttatccacaaaactctggttctagcacacaacacataacaattcca

SEQ ID NO: 529 - DNA, 201 bp, Homo sapiens
agtcaactcatatacttgaaacattaagatttgtccatttctaatgggattgccagtttaatcaactttgactcttttgttgctttccttcatttaaattrttaacaaataaaccaatttccacttatgagcaaaagtggatagatatagtggatagatatagactcacattcaattcaaataattatgagtagctggctc

SEQ ID NO: 530 - DNA, 201 bp, Homo sapiens
tctttttgcccaggatatgcctagaaacatcatgagccagggcctgtaatgggggcatcatagctctgcctagtgctctatccaattgtggatgagctgayctccaggatgtaagacaaagtcctctttactcttcattctcctctccttaagcagaagcaaggagtcacttttgttgctgcgagcagcactgtctggagt

SEQ ID NO: 531 - DNA, 201 bp, Homo sapiens
agaagtagaggctaaaccaactcataccccaaaccctgggcacaaagataatcccaggtagtggtcctttccctgtatgaacctgttggaaaaacatctcrtccaggaaatccatttgctatggaaataaataaaatacaaaaggaaaaaaagaactccagagtgaataacaaacaaaattaatatttaacttgagacttt

SEQ ID NO: 532 - DNA, 201 bp, Homo sapiens
gtcttggtagaaaataaatagctttcatgtactgatacagaaaaattccaaaattgtcaaataaaaaaatcaaacaagacacagaacattgtaaagaggayattatctttttaaattttaaatttaaatttttattttttcttcaacttttaagttccagggtatatgtgcaggatgtctaggtttattacataggtaaac

SEQ ID NO: 533 - DNA, 201 bp, Homo sapiens
atgtaaagaatcactccacttataataaggcaagggagaatcatctattagaatagtgagggagcctacctagcaaaatgtattctgaatgagaaatacayatataggaaataggagaaatgaaaaacaatagcaatagagagctaactccttttgtttccccatcatagaggattaggggttggcatacctagtctggaa

SEQ ID NO: 534 - DNA, 201 bp, Homo sapiens
atattaataaatgttgtaatatatttttgatatttggcctaatacagattaaatctttaagacatatagctaattctttttttttgatatgagaggcatakttctatcgagaggagctttttccacatagcatgtattatccacagacctcaataaagaaaaaactcagagcattgcctatgttttattccagggtataga

SEQ ID NO: 535 - DNA, 201 bp, Homo sapiens
taggtccagcatccattagctattcttcctgatgctctccctcttcccacaaccctggacaagccccagtatgtgttgttcccccaccatgtgttcatgtsttcttatttttcagctcccacttataagggagaacatgtggtgtttggttttactgttcctgcattagtttgctgaggataatggcttccggctccatcc

SEQ ID NO: 536 - DNA, 201 bp, Homo sapiens
tttgttaggataaaataatacatttctccaaattatttttttcaaacacttaagctctactcatccaaatttcaaaatgcgtatgatttttcctttattgrtaattgttagttattagctactgatttttttggtcagccttatttatttatttccttggaattagtatacttttttcctgtcctttcttaaaatatggga

SEQ ID NO: 537 - DNA, 201 bp, Homo sapiens
agttcctgtcttcttgaagttttgtagaatgatagtatcatctcaaaaataattaattcttttcaaaaatcaagctcctcagtaaagcctttttttgaaamattagttctatgtatactgaaattgaaagaggacaattctcaagtgactaaaaagcggtttaaagcattttatcagaaataactatgttacctatctcat

SEQ ID NO: 538 - DNA, 201 bp, Homo sapiens
tgtgcagactacaagaaataagaaactcagtgcagtgattatattgtacagacttgactgagaagaaaacaacataggcctgtaattatgggaaatatagkatcaagaaagagcttgggatatgtatgtatatattcgtttttgtcagttagcttttgttgcttaacaaaccatgccagcatttagtgttttaaaacacaa

SEQ ID NO: 539 - DNA, 201 bp, Homo sapiens
ttggctatttattgtctaaaattgtaaattcctgaataatagatatcttcactaaaatgatggaaatttctagtaaaacagtttgaaacattaactgatawtccccttttaaagaaattgttttggtatcctatagccacagccaacaaatcatcttgtcattattatcccaataaaaataattacaatatatttatttgt

SEQ ID NO: 540 - DNA, 201 bp, Homo sapiens
ttacaatatatttatttgtaatactgagaaatcataaaaagtgttgtttgacttttaaaatagcttgattcaatcaatccacttgggtatactggtgtttmtacatatagtgtgtatatggcatgtgtttgaatatgtgtgtgcattagtgtcaattggtttagaacagtgtgtgtgtgggggggcaatatagtatagttg

SEQ ID NO: 541 - DNA, 201 bp, Homo sapiens
gtgggagaggccccttcacaagctggctttagcctgcttcttaggccatgagcattcttttcttaaactccttggatatttcaccctgtaaacattgaagkttgactttccttgttcatttcttcttctacttatttattttcaaatttagtacgtgtgtaacgtttatattggtaacgttattgagagcatgtaaattgg

SEQ ID NO: 542 - DNA, 201 bp, Homo sapiens
atagcccaaacctgggaacacaaagtccaagaaaagaacgtggaaaatctggtagagtggaggaaatggagcaaaaatcattgtctaattgtcagagacarccatcaaatccaggaaactcataagaactaaagagcatgaaaactggtagagaagcaaatatgaagcatcagtaacagactctgatactgaatgtatctg

SEQ ID NO: 543 - DNA, 201 bp, Homo sapiens
aagaaagaagaaatgaagcaggaagtcaaatgaaaaaaagagacagaggtgtggacaacttaggatcatggcccagatatcaggcatctccataattacargtggctatagaaatcaggaactgcctggacgttttttttttttttttttttttttttggcagcacttaatggaggaatattgttctcatgtgtatactct

SEQ ID NO: 544 - DNA, 201 bp, Homo sapiens
ctcttttccctaccaaaatgactatgcttgacattcaactttgatgattatgtcagtgactttcaggtttctatctaatgattcatcaagttgtatttcarctgtgaccttcaacttcccttctttatgtcacccacatgttaatattacaggataaatacctttgtcgtaggtgaaactgacaatactgccttttactct

SEQ ID NO: 545 - DNA, 201 bp, Homo sapiens
cttttatctaattcgttttttaaaatgccaaacaggactcactgatagtcatgacttgtggttggaaaaacacggatctaggctagcagctgtgttttacrgatgggaaatccagagtctggcaacacaagtgttgtctaaggtcaaaaagctcattagctgctaaaacgagggggctttttaaaacacaagtggaatttc

SEQ ID NO: 546 - DNA, 201 bp, Homo sapiens
cataaacaaacatgcaaaacgaaaactaataaaaaccctacactttaacttcatgtccctgctttttaactttttgttgtttttttatgtcttattatackatgtcttagaaagttgtaattattatttttgactggttcatcatttagtctttctacttaaaagcagtttacataccacaattacagtgttataatattc

SEQ ID NO: 547 - DNA, 201 bp, Homo sapiens
cctgtgcttctctccagctagcctctctgaattgatcctagtaacggttcgcactcaggtgttcaatgattgacaaaagcttgtcttcctctctaacccckcactccctggggggatttgctttttttttttttttttgaggtgtagtttcgctcttggcgtccaggctggagtgcaatggcgcaatctcggctcactgca

SEQ ID NO: 548 - DNA, 201 bp, Homo sapiens
accagggagggcgttgggaaaggatttttcccccggctcccagtgaattagaacggggcagtcgtctggactccgagtcctggtggaggagtgaagccttrggtgagaggcctgtggcatcgggagaagactccccaggcaaagggccactgcccggagcgagggccgcagcactggagaggtaagagagttcttcaggca

SEQ ID NO: 549 - DNA, 201 bp, Homo sapiens
ttaggatgtggacatctttgatggtgttggggttgaagacatcattctgcctgctactggtggtcagatgtgccatagagtataagaaaccttgggagaargtggctatttccaagtaacagtagaggagagcctttaaatgctgctgtcaaatggccaggacttgatccttgttgaagctgggcgatgagaatgtagaga

SEQ ID NO: 550 - DNA, 201 bp, Homo sapiens
caagatacctgaaaggaaaagttgactgccaatcaaaatacgttgctgggtgaccaagaaatcaaagttaagagaggtagatattttaggagtatttcatmcaggtcatagtaaaacccagtccaggaataaaacattgtatgtatctataccagccttgttttaaacaaaatctaaaatagcttaaacacaatacaacag

SEQ ID NO: 551 - DNA, 201 bp, Homo sapiens
tcaggtttcggtaagcctttggaagacaaccaataatcatttgtagttttaacagggggtacttacttttattctagagcacttttctctcaggctttccrtaaggtgctgttgtccatcacttagtaaccttttttcaggttttacttggtggttctgtcggtcctgctttggtaaaaagaaaataaacagggcttttgt

SEQ ID NO: 552 - DNA, 201 bp, Homo sapiens
ttaattcttaatgattcttaaactttgtttctttcagtatttatggcagtgggagcttcaattgccgctcgcttaggaacttatcctgactggtttttttyctgctcttttattgggatgtttgtgttttattgcgctcattggcagacttatgtttcaggcatgttgagatttggaaagtaagtatgctttttaagttgt

SEQ ID NO: 553 - DNA, 201 bp, Homo sapiens
aaacaatataaatgccttttatgagtatggtatgtgcctatacgtctgtggtttacagttcagtaggtttaaaacacatggccagcaatggttaatgaaamctggctcagttccactggtcacaataaaaggctaggttgtccattcctacttgagacttggttgattataaacctaatcatgataccaacaagtattttt

SEQ ID NO: 554 - DNA, 201 bp, Homo sapiens
ataacatcagtgataactattagcaatttgatatatggtatatatttttttccctctgcatataccgttacctatgtgtgagcacatgttgttctgtaacytttttaacttaacagtgtagtcaactgataattcaataatggaagtaaaggtaaaaataaactaagcctacagagatttttacatctttgctatttaata

SEQ ID NO: 555 - DNA, 201 bp, Homo sapiens
cgacgtggatgacataatttctattcaaaatgattataaaatacagaatatagtgcttgagagagacacgttagccatctaaggaaaagaaaatcaatatyggtaacacttcaattacaaagttggataaatggagcattattacattttttttctattgagacatatctttatggttggtctccaattaatggtggcttt

SEQ ID NO: 556 - DNA, 201 bp, Homo sapiens
atgtctatggaaactaaaaaaactacagtgactattagtacctcaataaagaagactattggaattttccctgctttttaagtgaaattgacctgggagtrtttaaatttgccttaaatcatatggttgtttttattataatttttccttatgtacacaagtagtgggtaattattgtgaaaaaacttcagactttacagg

SEQ ID NO: 557 - DNA, 201 bp, Homo sapiens
cactattacataaatattttatactttcagtattatctataataaatttataaaacaagcactgtttcaccaccggacagagcaaaggtttcaaaaaagakttgactgtatgaacaatccatttagaggagctaaatattaactcttttttaagataactaatctctaacaaagctcatattattgatacttaatatatta

SEQ ID NO: 558 - DNA, 201 bp, Homo sapiens
atttttagccagtttaaaacgtgtgtgaatatcaaactggaatcagacatctgtggcactgtattatgtctctgtcaccctcaggttctatgaaaccttgraaagcacaactcaggtttgtatactcctgtaggccatacactacatcacactgttctttaggcctcttgcacaaaatagatggtcagaaaatgtctacat

SEQ ID NO: 559 - DNA, 201 bp, Homo sapiens
aagcatattgactgactaatagcccaaggaaaagaggagatgaagttaggggaatctatgagtgaaggaaatccccctgtgcaggaggctagtataccatmaataaggttatatttgaatataaaacataaaccctgtagatttcattgtgtcttatttcagttatgaagcccccattgtatcatcattttttatcacaga

SEQ ID NO: 560 - DNA, 201 bp, Homo sapiens
aggaagctgaggtgagaggactgcttgagcctgtgaggttgacgctgcagtcagctgagatcacgccactgctctccagcctggggcaacagagtgagatygtctcaaaagaaacaaacaaacaaaaaacacttttgaagacataaggtaggttaaaaaaatcctttgtaattagaaaatgtgtcacttttttagctaaga

SEQ ID NO: 561 - DNA, 201 bp, Homo sapiens
tgtagagacaatacaattcagggacaacaggtgtactatcccatcatctttagccagtatgacccaaaggtaacaaacgggggaaatcctcccactgatgrttacttcatattctcaaaaaagactggattttggagagactatggatatggcatcacctgtatttacaaaagtgatcttctaggtgcaggtggatttgat

SEQ ID NO: 562 - DNA, 201 bp, Homo sapiens
atctgattcctgttggaatcacaacactttataattttcagcatctgctcacaatgtttgaaaaattatggcttgttagatatcctgatgccttaagtcawatctcagaaatctatttcagtactattcctcactataattaatattgtttaaaacaatagagatgtctttgaaatttaaaaatataagaaatatttttaa

SEQ ID NO: 563 - DNA, 201 bp, Homo sapiens
attgttgttttgtataatctcatgactcaaagatagagcaatgtaatatacaaaagaaaccatgtatgaatgtgaacttcagtgcaagcatcagtgtaatragcagctcaggaatagtaccaaatgccttaggaatttgatctttctgcaaatatttattgaggacatactaagtgtcagggaccattccaggtgccaagg

SEQ ID NO: 564 - DNA, 201 bp, Homo sapiens
ataacataaaaaagtcaattaatacatattttatatgttatatgcattatagaccgtattcttgtaatacagtaagctagagaatggaaaatgttattaaraaaatcattaaaaaaccatcttctattcattaagtcaaagtagatcatcctaaaggtctttaacctcatcatctccacattaagtaggctgaggaggata

SEQ ID NO: 565 - DNA, 201 bp, Homo sapiens
catgaccattgtttgggctgtgtgagtgttttgtgcatgtctttctagagtttctgaagcacacattttacttttttaaccctctatacacaaaatgcagyatattatacatattgttgtgcactttgatgttctgtttctacttaatggaaaaataatttgcatcaaaattgatttgaaagtgattgttgtaaattgttg

SEQ ID NO: 566 - DNA, 201 bp, Homo sapiens
ccagttcctgagtaatctgctgtggtggtttttatcatggcaaatcagccaagctaaaactacttttcccagaattcccttccacccatggttctggatgwgggttggccacagggaaagttgtgagagttatagagaggagagaatcagcagacattagctcctaaggtcgttgtaaggtaccaggtgccaccataatta

SEQ ID NO: 567 - DNA, 201 bp, Homo sapiens
tatgaatatggtttgtctgcttataactttatgcctgtgctactgttattatacctgagtgtttgtttgcaaaaatatacactattatttacctattttaycatgtaaagtggcctgtgaagtgttctgtcatgctttcatatgtttctcaaataaatatattttagaaatgtaaataaatatctttcaaattatttttat

SEQ ID NO: 568 - DNA, 201 bp, Homo sapiens
gctagagtggctcatgcctgtaatcctaataatttggaaggtcaaagcaggaggatcacttgagcccaggagttcaagacaagcctgggcaacaaagtcasatcctatctctgcaaaaataaatgacaataataataataataggaaattgtctgcacttaggtaaaatgaactagtttgaagcaggccaatattcttgct

SEQ ID NO: 569 - DNA, 201 bp, Homo sapiens
tcccatttgtttgtctttttactagcagtacaaacttatggattccttttttcaatggtttataattaattatttaactattttgctgcttaaattatccratgttaggccagtgagagcctctccaaactgtgtcctgtgtctttgtggcatgctcccatttgattttgctcctcactttctagtacaacaagatattac

SEQ ID NO: 570 - DNA, 201 bp, Homo sapiens
gtctgacatctgctaatcttcagagggcagtgcagtgctttagaactgtatatagaactttggggaaggtctgagcagcatagaataacgttggacttgtyattaactccttcatgcgaagagcttactgcttttttgaagctttgtcacatttacagcgtaatgacagccaagacactggtttgtctttttcattaggcc

SEQ ID NO: 571 - DNA, 201 bp, Homo sapiens
tcttggggaaagaatgaattaatttctatttcttaaaacatttccctgagccagtaaacagtagtttaatcattggtcttttcaaaactaggtgtttaaawaaagagacatatatgatattgctgttatatcaataacatggcacaacaagaactgtctgccaggtcattcttcctcttttttttttaattgggtaggaca

SEQ ID NO: 572 - DNA, 201 bp, Homo sapiens
ccctggaggtcatttcatagctgagcttcttaatatttggcaatatattctttttccatcaaaaaatatccaggcacctaaaacactgtcagaactggctrtgcccctatgatcacctcctgctggctggtatttaatgtacatctgtagcactaggcagcattttctctgccaactaattccaggaactagaacactcaa

SEQ ID NO: 573 - DNA, 201 bp, Homo sapiens
cttcaatgccaagttctcgtcgtctttcagccctaacttctgcataactacaaatggaaaaaataatcaaattttagtgtctggtcattcgtttaaaatastgcacagctgtaactattcagtgttgttacgtgtctcatctgttcatctagactatttgctatgtgctacacaaacctaaaatatacctataatgtctta

SEQ ID NO: 574 - DNA, 201 bp, Homo sapiens
actatgtcccacccagaccaagacaaataaatagatcaaactgacttcaaaaaaatcatagtttattcaggacatagaagaaatctcaaaatagaacaaartattctcaaaggactactgaagataccgcattcaattaaacaaaaataggtatatttaacaaataataatacaagagtccactatgccaagaactgttac

SEQ ID NO: 575 - DNA, 201 bp, Homo sapiens
tcacaaggtaggtattattatcctcattttgtagactagaaactgaggacaaagagattaatcatttgcccattgtcatggttttgaagttgtggagctgkgatctaaacccacacagtcaggaagtctggttccattgtcaatgcttttagctactatcctgtgttgtctcttgaaatgataccagcagaaaataagcaa

SEQ ID NO: 576 - DNA, 201 bp, Homo sapiens
acatttggggtcagatacccactccttcacccaaggataaaagttggacaaaaagggatctaccatagccaaaacctccaactctctaccctcagaccacrtaagttcaacacttggcaagaggaaaaacacctgacagaatcactgaagccaggttcctggggtgtactatggtttttcctttcctttttatgcctcacc

SEQ ID NO: 577 - DNA, 201 bp, Homo sapiens
gaaccagcaagaatatgtaacactaatagatacagctaatacttgtaaaaaagatgctgactgaaatctaaaatagggtacaagtgcatgaagtacctcamcttctaaacagctgccaacatttggggtcagatacccactccttcacccaaggataaaagttggacaaaaagggatctaccatagccaaaacctccaact

SEQ ID NO: 578 - DNA, 201 bp, Homo sapiens
cttgctaaaagaatgtgtgtgtgcactttgctaaagagcggggctgaaatcacaagcagtcagttctaacatgatataattttattatttttacaaatgtyaaagtctccagaactgtttgtgggtaaaaacttactgccacctggtggatctgagttaagacaaagggaaatagatatcttttttaagctctcctaaata

SEQ ID NO: 579 - DNA, 201 bp, Homo sapiens
tacatttcattcatttactaattcatttgacaaatatgtattagcactcatgtgctctgttctggacatgtttagtaagcaatgaataagacatttagctrctttcctacagtttttccttctttttcctttttttctggagacagggtcttactctgctgcccagactggagtgcagttgcacaaacatggctcactgca

SEQ ID NO: 580 - DNA, 201 bp, Homo sapiens
attaaacttgtcttagctggaaccaactctctataccctgctgaggtttgtgggtcttactctgtccttcagagtgttaatgaaatttttcttagcttccygtcgttcaaatgttttttaaacatacctgggtctttcatgcaagttactaatacaaatttgaatgagatgtagctaagaactaaatctgaaatcacaaat

SEQ ID NO: 581 - DNA, 201 bp, Homo sapiens
atatccaactaaagtaataactcagagttgaggctataagagtaagtttaaataattcaacatttgcataatcaaaaaaatggaaaaaaacaggaatctckgtatccacctgtttcacagaagttacacctaatagggcttttaataaatggttgtaaagcaacctgtaaatataaatgccattatgtaattatagtcaat

SEQ ID NO: 582 - DNA, 201 bp, Homo sapiens
cctttgccagcaggcacaaagttatccacatcagtaggtggtgctggagggacactgccaagaaagtgctcaactcctggttctggtgcttcttgctcttwtgtcagggtgccaacgggaagcttttaatattttctcaaccacgtttaacatatgatatggtctggttattgttaatttctgaaatcaaagttgtgtgcc

SEQ ID NO: 583 - DNA, 201 bp, Homo sapiens
aaatatcattttacgatgcattctaagatgcacctttctttaccttttgtactccttggatcttttaaactgattcttcaggaaactataggttcaaggtmctcttctatatgaccaaccataagtctcagaattctgtttaaacaagaaaaaatgttagatttattcaacttacatagaagtttatcattaaaagggttt

SEQ ID NO: 584 - DNA, 201 bp, Homo sapiens
agtcaaattccatgctgcttactgataagctgggggcactggcttctgctcttgctctttcttctggaaacattattctgttcctttggacatgggcaagsgtcctgtccctaacttgtccttctttttcttttgatcttaaccagtttcacttgtaccaagaccaaactttcttacctttccatgcagggaaacaggcac

SEQ ID NO: 585 - DNA, 201 bp, Homo sapiens
tctgtattccttggatgtggaattcatcaatgagatcctcaacatacgtaccaagtgagaattggggcacaggtagggcactggggaggaaaagcacccaraggtatatacatgacccttttcacttcccagagaagttcctagactgcttctcacagctgttccccattccttagaagccagtttggttttctaattctg

SEQ ID NO: 586 - DNA, 201 bp, Homo sapiens
ctataatcaccccttacattgtgacttcttgcaaataaatacaccccactttcagcctcactcatttattataaaattgtaagaggtggaacaagcctttrtttagagatgtgattcatgtgttgcttgctggagtttctgaaaacaaacaaacaaacaaaaaaacccaagatagcagatggccagatgagccactgggaa

SEQ ID NO: 587 - DNA, 201 bp, Homo sapiens
catgcccagctgggcagtgccacttgtgtctgagcctcagcaaaactgcatgtccctaaatgtcaggggtcttcacagacaagtgaagcaaccagaaataytgaattttcagatggacatgtttatcgtactgaatctccatagccaggaggcacagacaactaataaagccctgtgccccattattgcttcattgattca

SEQ ID NO: 588 - DNA, 201 bp, Homo sapiens
ctggcttcggctgtgtcttttgtgagtcatccttgctgctttgttccagccccactgatgggcctcctgccctcccccatgcaggacttagtcaccgctcstgtcatcaatccctctggaatgcacccctcctccagacacccatgctccccacatcctttattattttgttaaaactagcaatgccccccccaaccccca

SEQ ID NO: 589 - DNA, 201 bp, Homo sapiens
ggtactatgctcagtacctgggtgacaggatcattcataccccaaacctcagcatcatgcagtatacctaggtaacaaacctgcacatataccccagaatytaaaataaaagttggggagggagggaaggatagaaagattaaaaaagtaatacacaatggtggggcatggtggctcttgcctgtaatcctagcattttgg

SEQ ID NO: 590 - DNA, 201 bp, Homo sapiens
gagacaggttttataccacattgcccaggctggtttcgaactccttgattgaagcgatctacctgccttggtctgacaaagtgctgagattacagatgtgmcttgcctgacctgattattgttttttatatctcctttaatgtacaggttagctctctcattttttccccctcttgaaataggtttgttggagaaaatgga

SEQ ID NO: 591 - DNA, 201 bp, Homo sapiens
tgaatcctccactctcctggttctctcctctgtgctggtaggaggggaggctgggagagaatgggagaggtggtcatgatcagtaaagagacaattggagrgagatggtccaaccctgtggttctggactctgaagtggtctttactgaaaacagcagattcctaggctcagaacagtggcaaaatagcttggaatttagg

SEQ ID NO: 592 - DNA, 201 bp, Homo sapiens
tgcccggccgggatgtatgctcttggatccactgtctctcacagactagtgtgggccttgggcccccctcattttgacatccttccagatggttccctgcycctaggccaacctccacagtcatgtgggccatgatggccctctggtggccctctaacgtctccagggcaatgtgggcaatctcagcctccgtcttcccca

SEQ ID NO: 593 - DNA, 201 bp, Homo sapiens
aactgcctcttaactcacccgcacagacgcggcttctgcctccgcctgcataattagttgggacctgtggacagaagggaagtggagggtggagcccagcrgcccttactcccaggagaaaggcccagtgctgcagaggcagacgctcctgaaacctgaaatccataggagtccaggtggtgaaggcttcagcactccatc

SEQ ID NO: 594 - DNA, 201 bp, Homo sapiens; identical to SEQ ID NO: 179

SEQ ID NO: 595 - DNA, 201 bp, Homo sapiens
cattgccttgaaaagctctggaatagctaactctcgtcccatgccagtgtcttcctggtttgaggttggcgcatggaatactgggaagatacagcatagayccagtctctcactcaaccgggagacacagggccctccgggaggctgaggtgtggggaactatagctcttgggctgttcctgatgcctcgtcctgtcttct

SEQ ID NO: 596 - DNA, 201 bp, Homo sapiens
tgcccgccatctccagcttagatgagtgcagtagatgccaaacgcgtctccctgcttctgcccttttctgcctggagtcaaatctccacctgggggggcgrcatccagtggaccttagagcatgtaaatcagatacgtcacacctagctgacacccccatgctggctttccactctgccagaacaaaagctgagtccctag

SEQ ID NO: 597 - DNA, 201 bp, Homo sapiens
caccatgcctggccaaaaatcttaagatgtttacaacatccaagatttatttttgctcatgctatatgtattcattgcaggttggctatggccctgtccaygtcatctcacaccaggacccagatggcagagctggagcagtgacaggtgtcatgagaggagaaagagtcatggagaaccacacactggcctttgaagcta

SEQ ID NO: 598 - DNA, 201 bp, Homo sapiens
cctgccactgcctgctggagtggccgagtatggtactctggccaaccactagcagagcccagctgtccccacaaaggtgacaaaaatgtgaaggaagctgycttgaacactccagaccagccagctgccgaagatggcattgagtgactccagttaacatcaagcagagtagaattgctgaactgacagacacaatttttt

SEQ ID NO: 599 - DNA, 201 bp, Homo sapiens
aagaagtgggacatttggagccccagacaaaccaatgacacagactgagacactgtggagctggatgcctttctgtgtgtttgttagagtatgagaagccygctgggaacaagtaagggcatccctaaccatcagtgtccattgcccaagagagatggcagaagtgggttggtccaaatcctttccgttgtaaatgtggag

SEQ ID NO: 600 - DNA, 201 bp, Homo sapiens
agctttccctgttaatgtagtcaacttaagctactgccatggttcaggttccatcatgcttcaaatatagtttatgactgtagttacgtagtgtggcagcracacagggcaacttggggctggggagaagtgagcgtgtctttccctccccaaatgcagtcatttagcatcttcctctttcagagtcctgtatcccagcga

SEQ ID NO: 601 - DNA, 201 bp, Homo sapiens
gggggagccctttccccatcttggggctgtggatctcagctttccagaatatttgtgtgcatgtgagtgagcacatctgacttaatttttatattcagtayagaatcatgactcagctttccctgttaatgtagtcaacttaagctactgccatggttcaggttccatcatgcttcaaatatagtttatgactgtagttac

SEQ ID NO: 602 - DNA, 201 bp, Homo sapiens
ccctgatagtgggtgggatcgcctgggagagtacggaggaagaggaggatggattcagaatggagtcccagtgcttgggtagtgcatggaggacaggaccmctgaacaggccggcaaagtgtgggtagagaggtcaaggagagagaggagaagttactgtagaaatcgataacttcaacaaatgagagagaggtcagctgt

SEQ ID NO: 603 - DNA, 201 bp, Homo sapiens
tatcgtcctcttctccttcaaccatggaaacttgattttgtctgtggcatccatgtgcctctttgaaacactcacctcctcagactgccttgaatccaggsgtggccacatgactgggtaatgagtcaccggtagaagtcggcttgatggggcttttagggaaacaacggctttcctgtttttgtttttcttcttcttctt

SEQ ID NO: 604 - DNA, 201 bp, Homo sapiens
tcggcatcagccttgtgcctatacccacaggagcaggagcacaagccattgcaggtgcgggctcctcagatggagcaactccaatgtcacctgctcctcayctgtacccagtggacttttttggcagcctcccccatcttctcgtgtggctccatatctttatatcttctgtggcagacgtagcctgctgcctccccaaac

SEQ ID NO: 605 - DNA, 201 bp, Homo sapiens
acttgggagaagggggtggagccacgggaagttcgtgccatgtgcagttggggaggagcctggcctcttcagttcttgtgtgtagcctggaatcagtctgsgggtgggggtgctgttggcaggaactcttcttgctttgctgagagatttttttttcttcttttcctttttcacccaataaattctgttcccctcaccctt

SEQ ID NO: 606 - DNA, 201 bp, Homo sapiens; identical to SEQ ID NO: 244

SEQ ID NO: 607 - DNA, 201 bp, Homo sapiens
tagggctgtgtcatgttccacacacgtggggatatgtgggggcggccatgctgccaggcacatgtaggggcaagggcaagaggacaaaggtgggaatagcyttgttgggtggacccagtttctaacagctagcgtttgcatatcaaaggttgctggcccaagtctaagagccagggctttcatgctagacaagagctgtga

SEQ ID NO: 608 - DNA, 201 bp, Homo sapiens
ttggctgtgtctccacccaaatatcatcttgaattgtagttcccataatccccatgtgtcatgggagggacttggtggcaggtaactgaatcatgggtggygggtttttcccatgctattgtcatgatagtgaataagtcttatgagatctgatggttttataaagggctgttcccctgagcatgctcttgcctgctgcca

SEQ ID NO: 609 - DNA, 201 bp, Homo sapiens
gattcgcaacaaaacagtggttccagagcctgtttgctgacttctaccatgatctacaggtgaattaactggggcgctgagaaaagcagtgatatgccctrgaattaattaactgtcaataggctgcaactagttccctatactagtggggtgaccacaagcacaggttgcagagacagtcgacctggatttcactccagc

SEQ ID NO: 610 - DNA, 201 bp, Homo sapiens
gagccagtgcaccaggcccaccaatgagtcttaactggggaaggcataggcttagatgcaggatccagggatggaaaatggaagctgagaagaatgacaartcacgtgtaactggtttccagaccagcatccacatcctctgggaacttgcagaaataaatgcaagtttttcatcccacccagatgtactgaaccataaat

SEQ ID NO: 611 - DNA, 201 bp, Homo sapiens
aggtctcagtcttttgagggagacagatcagtaatggaagctttctaatgtacagctaagtaaacggtgatcaatagtgttaggtaaagtgtggaggagargtccgtgaacaatcctggggagatgacaccattgttttatcttgttaatgcatttacttcacagaatcacaggataatggaattggacggcaccatgaga

SEQ ID NO: 612 - DNA, 201 bp, Homo sapiens
gtactggtaaggacactgactgctttatagaccctcacatcattgtttctggtacccaaactgctctgagcaccagtcagtctttactgtagtctctgacrgctcactacagccttgatgtcctgggctcaaacaatccatctcattctcccaagcagctgggactgtaggcataagccaggtgagccagtgcaccaggcc

SEQ ID NO: 613 - DNA, 201 bp, Homo sapiens
cttcccatgttcttctcaacttgccaaaacaccaaactctggggtatcattttctgagccccaacaccttgatggaagtatttacaccacagaaatcggawatgttgcaagtcagaactttcacctacccccagccctccactgcctctgagagttaaacatttacaggccactgccacatctgctcctttctttccttca

SEQ ID NO: 614 - DNA, 201 bp, Homo sapiens
aaaccacttcttcttcagaaatcttgtactgagaaatggaagcccatttctgatcacatacatgacccatgcttcttcagaaaggaaggcatgaagttgamgggggaactaagactgctgagttcttctgtcttcggccacaggaaactaactgattcatggcactttgtacccatgagctcatctagtcctcccagggca

SEQ ID NO: 615 - DNA, 201 bp, Homo sapiens
atgaatgctgaattagttaatacctaatttgttcctagaagaaatacaggctaggttcccgtgagcctctggtcaaaacattttcatcaactgatcaacawagagccttgctttatatgtgtttctgtttaaagacaccttatgtaaaatatattgttgattcattaacactgaactcacagctaacagcagtataactta

SEQ ID NO: 616 - DNA, 201 bp, Homo sapiens
tcagcttaggaaacagcttttgtaaaactgcgtaactagtagtaggtgagagaggaatacgaatgatatacacaccattaaagacaacttactaacagcaygagtccgacatagattccttcctacttgggtttgaaccctgagcccaccacttactagctgtgagaaagtgaatgagttgcctccctttcctgtgcctct

SEQ ID NO: 617 - DNA, 201 bp, Homo sapiens
taaaaaggacctagcctagcagcaggcatgtagtaagagctcagtaagtattacatttgtttaattagtgtctgcctaccaggttcaacccttggcttcayatgtccagcaacacttcctaacttgcccattcttgcccttccttgggtcctgctgtttattctgttctctgaaataaggagttcctcccagtattgtagc

SEQ ID NO: 618 - DNA, 201 bp, Homo sapiens
acttgaccatgtccatgcctgcttcagtaagttcagtggctccaaactctctgagttcccaacccaaatccaggcaccttgcaggctttctctttcaacayccccattgcttcttgatgttgtgcatctctaattttgtcctttttctcacacatgccaaactcttacccattggaccctataaccgttctatttcttttc

SEQ ID NO: 619 - DNA, 201 bp, Homo sapiens
acccccaaaatccattggtgtggggttagatgagggatcctaaaaggagagggaggctgctgtgcagtgatcccaccggcctgcttgcaggaaggagagcygaccctttcttgacctctaccaaagacactagagagctttgtaaatcttccaattagatgatacataaatacttccccaggtcttctaggcctgattcaa

SEQ ID NO: 620 - DNA, 201 bp, Homo sapiens
ccagtattgtagctgataaggttagagctcaaagcagttagggacctcaagaggtatcctagtctggttcctggtctagataaaatattatcccttattgyagaagtagcaactgaatctaggaaaggttgagtgatttgagagactatagtaggcataggtggggatattggctaattcttagttcttctgacttaggag

SEQ ID NO: 621 - DNA, 201 bp, Homo sapiens
agtgatccgcctgcctctgcctcacaaagtgccgggattacaggcatgagccaccgcgcccggccgggtgctctttattccccacctctagccccatcctrtgaattcttctttatgtccgcttgtcaccaccacccagactactctgacagcctccccagtggatttcccactatgcttattccctccgattcttgctgt

SEQ ID NO: 622 - DNA, 201 bp, Homo sapiens
tcccacccctcctgtgaaaggctcccttctgagttccaggtccctatctgatgacccacctcacctatgcctgcctaatacctgaatggccatctctttcmgagaccactcttattcccaggtgtgtgacctcctcctacagactacagtgggaaagacaccatctccaggtaaccccaacacagtgaggggtggagcggg

SEQ ID NO: 623 - DNA, 201 bp, Homo sapiens
agcctgagtgtcttgaaggataactaggagttagcaatggcaaggtttctgaggagaaagagggaccacgatgggcagaggggcaataggagccaggtagytgcaggtagtctggggttgctggacccttgatgagaggctgtgggcagcaggagatgaggctggagagggattcagggtcctatcacagagactcaaatg

SEQ ID NO: 624 - DNA, 201 bp, Homo sapiens
ttgtgcatcctgttccttttataagaacaccagtcccatcagattagggcctcacccttaggacctcatttaacctgaatcacctaaaaaccctatctccmaatatagtcgcattgagagttaggggttcaacatacgaatttggggggacacaattcattccatagtgtagggtccactgggccttttttggttgagccc

SEQ ID NO: 625 - DNA, 201 bp, Homo sapiens
aagcaggccctgcaaaggggctttctggaaaatttgagcctgagtgtcttgaaggataactaggagttagcaatggcaaggtttctgaggagaaagagggrccacgatgggcagaggggcaataggagccaggtagctgcaggtagtctggggttgctggacccttgatgagaggctgtgggcagcaggagatgaggctgg

SEQ ID NO: 626 - DNA, 201 bp, Homo sapiens
tggggagcgaagctggacgttgcagccctaccctgtccccagaggtttttctgtccctttatgtctatgaacaagtacagctgaggccatcagcactgcasacacctggaacagtcttgttaaaacaggacctccctaaaggccaagagctaaggaaagagaaagtgaaggactgagcagcaggtaaccagaatcagagtc

SEQ ID NO: 627 - DNA, 201 bp, Homo sapiens
gagatgaggctggagagggattcagggtcctatcacagagactcaaatgttaagatgttggtctttaagtggatgggctcggggatatttgggctgttatktggggaagtgacatggtcagatttttagctaaattgctctgcctgccatgtggacagtgtgttggggcagcatttctttgcatgaggtctctggggattg

SEQ ID NO: 628 - DNA, 201 bp, Homo sapiens
tgtcagtattcagcagtgtgcctgattgatatatactaggtactcaatggttttgactgaatgatgaataaataaatgaataaataaagaagcccagattytcttaatttaggtctatgctgtctaatacagtagcatgtggctatttattttattttattttttgagatggagtctcactctgtcgcccaggctggaatg

SEQ ID NO: 629 - DNA, 201 bp, Homo sapiens
ggaatgttctagcaccaggcctgatccgtcttggcacactccacaggcttttctatgtttagcctcctttccagctgcccagaggacacgccatagctggsagacatcactgtcgaggtgtgggtcacaagcttacccctcccatgaggcagggttaccagctttcctatcgtttgaagaatttagcaatctgagtttatt

SEQ ID NO: 630 - DNA, 201 bp, Homo sapiens
aactcctgggctcaagcaatctgtccatctcagcctcctaaagtattgggattacaggtgtgagccactgtgcccagctgcattctttttataacctcatytttttttgatctgcatcacctccctcctaccctattggtcagagtagtcacagccccgctcccattcaaagagagggaacatggcccctacctggagtgt

SEQ ID NO: 631 - DNA, 201 bp, Homo sapiens
tgggctcaagtgatcctcctgcctcagcctcccaaagtgctgggattacagacatcagccaccgtgcccagcccagaatctttcaacccccaaaatccatyggtgtggggttagatgagggatcctaaaaggagagggaggctgctgtgcagtgatcccaccggcctgcttgcaggaaggagagccgaccctttcttgacc

SEQ ID NO: 632 - DNA, 201 bp, Homo sapiens
agatcggtgccaaggtaagaattttacacctcttttatttctttttacaaggaaaaatccaggtaagttatgaaaaaatggttgtggggcatttgcaccckctatccttaatcaagatttgcccctctcaagtttgttacatttatatatataacaattgtagctagcatttgcctttggaaagctgggaatcatttttct

SEQ ID NO: 633 - DNA, 201 bp, Homo sapiens
ttcccagaccccttttgacatgtcagtgccgagttcctggttcatcccccatcattttcctctcccccagccaccagagcctcccctcacatacccttttyttttcccaaagaaggagaagcagacgagttgaagagaactccattttattatggaaagttaaaaaacaaacaaaacaaaacaggcaattgataaaggcgg

SEQ ID NO: 634 - DNA, 201 bp, Homo sapiens
tccacaccgggagattccagaagcttctctgctgactctggaggttctggtttctgagtttgagcctctatgtccctgggtgtccattctcgagccttccyggagttcagggtccatttccacccttctgttggcttcatgcccctctcgccatcttccacaggcctctgctctgctgcctccactcctgcggaactgttg

SEQ ID NO: 635 - DNA, 201 bp, Homo sapiens
acaagagtaaaataataaatcaagtaggaatggaggggaggatatgcatgcagcactagataatatctatacagagagaggatgaggtcttggaagatgartctgaagactttcctgttggagaggggctctatgctcggcatgctgactgcttttacaaccccacccccacatctcatcttaaccacaagacagtcttgt

SEQ ID NO: 636 - DNA, 201 bp, Homo sapiens
ggattacaggcacgtgccaccaagcccagctaatttttgtatttttagtagagatggggtttcaccatgttggccaggctggtctcgaactcctgacctcrtgagctgtccacctcggcctcccaaagtgctgggattacaggcgtgagccactgcgcccggccccagagtctttatttattatttagagagggtctcact

SEQ ID NO: 637 - DNA, 201 bp, Homo sapiens
agagtggccctggccagttacctttgattgccagagagatactagaagctggttgctgaaagactgaaaaaagaaaaaaagtcaggtcactcacccaaacsaggcaatgatgatcagatgcttccacatggacagacacctttcagtctcactggagtgtagctctggccagagacctgcaattgtctttgtgcttagatg

SEQ ID NO: 638 - DNA, 201 bp, Homo sapiens
ctgaagaaagtgtttccaggaggaaggaatggtttacttggtcaaatgctgctgatcaaggagcaaagaggtctgagaagttaccattggatttatctgcrttaggccattggtgatcttaatgagcagttttggtgcagcggtgtttggaagcctggatgcagtgggtcttgtagactgagaagctaggaacacagcaag

SEQ ID NO: 639 - DNA, 201 bp, Homo sapiens
tggggctgaagccacatccttctttatggtgtcgccatgtgcttctctgtaggccgagttcccataattggggttggtggtgtgagcagcgggcaggacgygctggagaagatccgggcaggggcctccctggtgcagctgtacacggccctcaccttctgggggccacccgttgtgggcaaagtcaagcgggaactggag

SEQ ID NO: 640 - DNA, 201 bp, Homo sapiens
acatcatcagaaatagctgttccttcaacaacactttttcttgccagcatattagatttaaaggtcgaatgatcttgcattgctgcctcttctgcattagractatcagcttcagtgtctccaaatttgacagcatgcttccactgtgcatatacatgcatttcacaatccattcctaccaccaatatcccatctcttacc

SEQ ID NO: 641 - DNA, 201 bp, Homo sapiens
cagcagagcctacagaacatggagaaaggacaccatcagccaatgagaagaccataccatctccagcaaagcctacagaacacgaagaaatgaccccatcrgccaatgagaacaccacaccatccccagtaaagcctacagaacatggagaaaagactacattggccaatgagaagatcacactatccccagaagggccta

SEQ ID NO: 642 - DNA, 201 bp, Homo sapiens
tctagaaacgttgcccattgctattgttgtgggactatgtacaggtcacttttcctccgtgaaatgtaaatttctcagatgtaaaataggggaagttgacygcttctaaagagccttatggagcattgggagatcaatcaccatagaagagaatccagaaagagaatgtctgtgaggccaccagccacatcctggggccgg

SEQ ID NO: 643 - DNA, 201 bp, Homo sapiens
atgcacgatgctcctaattaaatatcaaaaatgtaaagtaggtgtcgtatttgactaaaaattgatatttttcaggaaggactatgcccccagggcccacygtagcctttgagaccatggtggagtctgtgtccacaatggcctcaaccacaggctctgagagtacctcaacctctgagatcatcgccatctccaccatgg

SEQ ID NO: 644 - DNA, 201 bp, Homo sapiens
aaataaaactgaagttactcatcaggtgcccactggttctttcaccctcattacatctagaacgaagctgagttctatcacatcagaagccacaggaaacragagccatccatacctcaataaagatggctcacagaaaggtatccacgctggacagatgggagagaatgattcattccctgcatgggccatagttattgt

SEQ ID NO: 645 - DNA, 201 bp, Homo sapiens
ggactgcagtgagctgtgaccatgccactgcactccagcctggtgcagagtaagactctatctcaaacaacaacaacaacaacaaaaaccccggccggatrcaatggctcatgcctgtaatcccagcactttgggaggctgaggtgggcagatcatgaggtcaggagatcgagaccatcctggctaacacagtgaaacccc

SEQ ID NO: 646 - DNA, 201 bp, Homo sapiens
gggaggaagccgagcggtctgagccttctgtggggccggtggggttctcactgcgctggcagcagaggatctgcctaaaggtggcgctcatttctttgtcrcggtaggagtaaatgatggggttcatggcagagttgaattcagcaaggagaaggaagaatttctcataggccagcacgtcgcactgtggacagcacacgt

SEQ ID NO: 647 - DNA, 201 bp, Homo sapiens
caatacacatataggcatacatgggggttgctttttaaaggtggttacttctgggttgtgatattatcagtaatcatttttgcttttttatacatttctgyatttttcaagttttctatgatgagtatattattttacaaagactacgaaaattttcctctgatatactggtaattagaatgtacttgggtattttaaata

SEQ ID NO: 648 - DNA, 201 bp, Homo sapiens
ctctcagacatcctcctgacctcccctgacctgcttcaccactgtgttacctcactggttacttgttacagcaaactgatgcaactactagtctacctggrcaacatattaaacaggtatcacctaatagggtggcagcctatcggggtgattcctggcgaatacacagtaaccaaccacatactgacacactcaacccat

SEQ ID NO: 649 - DNA, 201 bp, Homo sapiens
ataatgggggtgtatgtggatggctttttgagattaacgctttttctaaaagaataacccagattaattaaaaaatcttttttcctgactattgaaactayataatttacctgaggtatctccacagtattattgttctatattatttccaccctgataccaattttactccatctagtttggtgttcaacactgccattc

SEQ ID NO: 650 - DNA, 201 bp, Homo sapiens
catttttttaaaaaaagaatccttcatgggaatatatcctaataatcaattatatggagacagttttatgtacaccaaatttctgcaactttataataatsaaaattagaaacaacctaaatagttaacaacatgggaatggttaaataaactgagttgcatccattaaatggaatataatatagccattaaaattatgtt

SEQ ID NO: 651 - DNA, 201 bp, Homo sapiens
acaaaccttggagacctaaactcaacaggccccaaactgaactaagcgtctacccttatgccttccccatactgtccaaatcagaaaattaactcctcagktgaagttgatgctattaatctatgaatgaccctttgagtagcaagtctgaaaagcaagaacttttttcatgactccaacactagattatcaagtcttcct

SEQ ID NO: 652 - DNA, 201 bp, Homo sapiens
ttcctgcatcaatgttaatttgactttaataattgcattgaggttatgaaagagaatgtccttatctgtggaattacataaaaaagtattcagggctgatrgggcatcatgttggcaatttattcacaaaatctgtaaatttggttagcttttccataagttccaaaatgcaagttatctttaacataaaaaattgggttg

SEQ ID NO: 653 - DNA, 201 bp, Homo sapiens
tacatacctaggtggcacattgtttcttctaacgtacatcttttttttggaatctcttttcttctccctcccccacccccattttctagagtgtatccatragcattctttctagaaagtttgcataagcttaaaatcattttctctcagaacactgtcttctagtatttagtcttgcaggtgagaagtctgatgtatgat

SEQ ID NO: 654 - DNA, 201 bp, Homo sapiens
tttctaaggttctcgactccaggctctggctcccagatggcatctctggaccaccagggcaagggagaacttgccagcttgaagggaaggacacatgttcrgctgaatttgctacctgctgattgtagagcacttgggccttgagcaaaagtaggcagtagccaggcagtggtcactacaggccttgggtgagacccagta

SEQ ID NO: 655 - DNA, 201 bp, Homo sapiens
aaatgttagcaattctccggggttgctcttggctttttcttttcccctcactctgcatgctttccttgagaaatctcaaacatgctcatgtttccagagcmatctatatgccagttatagatttttatttcaaacttactcctttcttctaaagcaagtcctgtatgtgcaattgctacaactcaacttcctacacaacct

SEQ ID NO: 656 - DNA, 201 bp, Homo sapiens
tatatccacctaaaattaaaggttcagaattctcttccaaatcctcattgagacattcacttgaataaatattttatctttttccaacaccttagtgatayactgaaaatgttataatggttatatcattggaagatatatatataacttttatcttgttggttattaaacctataagtagaaataccaccgtgactttat

SEQ ID NO: 657 - DNA, 201 bp, Homo sapiens
taagcaattgagatatgaaaaactgcattcaggaaacacttcacctcacataacaacatggtttttaatagcagtgttattttcaggcaaaagataagcaygaatgataagtgtcctttaatgtttaattaaggcatagtttctggattcaggttgtctgggcccaaatctttgtttgacatgtaataaactgggtgaact

SEQ ID NO: 658 - DNA, 201 bp, Homo sapiens
cataatttgtttggggagacaaaatagataaatatatataaggaattatcaattgcaatataaagaatatgtaattagccatcaaataatgctataaacarcaaatattagacccccagttttttctttgagactgtttcctcatgtgtaagagttaccacaaagatcaaaatacaaattatatgaatgttttatgtgagc

SEQ ID NO: 659 - DNA, 201 bp, Homo sapiens
tgcaggatgtagcgtttcatgcgtatggactcgagccactcagagacggttcgatatgggatcccatctgagccactcaggctgggcaggcgaagagtcaycctgtgggacatgggcatgtcagtcacagcgggtacatgggctgatctggttggccttggcctctgagcatcagcagccagcactgaagttcggtgtctg

SEQ ID NO: 660 - DNA, 201 bp, Homo sapiens
tatttaatgccctttatcagaaactccaaaaccacagaagcaagtgtgtaggagacaggggttgctccagggcacctgatgaggggtttttaacaagaacrcaatggttcaaagaggatacagagcagagcagagtgagtacctctggaaactcttggaccagagaagccagctgggctgcccagggaagcgctggaagga

SEQ ID NO: 661 - DNA, 201 bp, Homo sapiens
gctccagcacacactccatggtgtccagcccagccgagtggaagtgcaggatgtagcgtttcatgcgtatggactcgagccactcagagacggttcgataygggatcccatctgagccactcaggctgggcaggcgaagagtcatcctgtgggacatgggcatgtcagtcacagcgggtacatgggctgatctggttggcc

SEQ ID NO: 662 - DNA, 201 bp, Homo sapiens; identical to SEQ ID NO: 193

SEQ ID NO: 663 - DNA, 201 bp, Homo sapiens; identical to SEQ ID NO: 195

SEQ ID NO: 664 - DNA, 201 bp, Homo sapiens
tctttcccctctgattgtgtttgtaatctaggtgatggctagctggtatactagcagagtgagtggaaaaggtgtcagaaaagggtatcagaggctcagcractcaacccatctcattagagtcaacgaggcacctcttaaaagtatagaagaatggaaatcctttcttcatttgtgctttggaaaaagaaaaagagtaaa

SEQ ID NO: 665 - DNA, 201 bp, Homo sapiens
atatggaggttaatttggtatcaactatcaaatgtaaaatgtatataccttttggcttaacaatttcatttctaggaatatatgcatgtacatgcacataygcaaaatgatatagttacaggatatttattgcagctttatttttaataaatgattagaagcaaatgccaatgaataggagactggttagataaattatat

SEQ ID NO: 666 - DNA, 201 bp, Homo sapiens
gccttgtttgctgaaacagagccaccaggtaaagagccctcgactaccctaaggcttccatgctggagaggccactagtaagcactctggctaacagtccyatccgagtccagccatccggaagtggatcttccagccccagctgtttcagtcctcaattgctctagttacccctgctccccatcagctgtcggagtcctc

SEQ ID NO: 667 - DNA, 201 bp, Homo sapiens
cacaaatgtactttattaatcaaccggtgatgttgctcttaaagcataagtgcatctctatgcattaatgtatgctttgggatatgctatagtcacacgcyacatcgtgatgtttcagtcaatgacagaccacatatatgatggtgggcccataagattataatacagtatttttgctgttccttttctactttaagatat

SEQ ID NO: 668 - DNA, 201 bp, Homo sapiens
aataaacaaaatatgggcatgcatgctaaagggaaaatgtgtgcaggtctactgcattaaatcctgtgtgctcctcttttggatttacagaaatgtgtcamatgtaaatctttcaaagccatttaaaaatattcactttagttctctgtgaagaagaggagaaaagcaatcctcctgattgtattgttttaaactttaaga

SEQ ID NO: 669 - DNA, 201 bp, Homo sapiens
tttgtgtgatggattatgtttattgatttgcgtatgctgaaccagccttgcatcccagggatgaagccaacttgatcatggtgggtaacctttttgatgcrctactgagtttgctttgccaatattttattgaggattttcatgttgatgtttatcagggatattggcctgaaattttttttttgttgtgtctctcctagg

SEQ ID NO: 670 - DNA, 201 bp, Homo sapiens
tatatagaaagttttgcagaaactgcctgacctcttttctggggccttcacctgctgctcaggggtggccctcaacagctatgtctgtcctctaacaccarcatccctagctcagtccagttagtccaaaggcagacactaaatacagggtggaccaatgacattccctttttaactgaaatgattacagttgttgataac

SEQ ID NO: 671 - DNA, 201 bp, Homo sapiens
ctgtaataattcttgctccattccagccctttcagaagaggggccttctttcttctaactaggacttagccccctctccaatgccatagtagctgtactgsagactaattcatatgaaatttaccaggtctggaaaaaacttaaacagaaaatattccaggtgtacacaggagaactcaagtgtggtgatgaaatcagaga

SEQ ID NO: 672 - DNA, 201 bp, Homo sapiens
ctgggtggcgcaggtggagcagggcctgcacgggaattcgggaggccaggtagcccacagcagtgtagggctcctggatctgggcgatagggtagatcccygccagaacctgagggaaatgagcactcagtactttcctcaatgtcccaccttctctctttcccttacccaccctccccgtcatacctgcaactgcctagg

SEQ ID NO: 673 - DNA, 201 bp, Homo sapiens
cattgatatactcattaaaatgtgactcatccaggaaaatcccatccctaaattatttaaagtttttgttttccctcagctactatttctgttctaccttrtgcaaactaatgagaaaccattgtcccaagactggtggcctcctggcatggttgtgcaacagctgttgtcaaactccagagtctaaagtgcaccacgaaa

SEQ ID NO: 674 - DNA, 201 bp, Homo sapiens
gataagtagacagaaaaatcgattaatacagaagctggcaaaaactagtaaagcaaatatggcaaaatgtagaatttgttgaatctttcagtatttgggtrtttattgttctttttctatgttagaaatttttcaaaataaaaagttgcaaatgatttccatattattctgatttttacacagtaacagaaaacattcctg

SEQ ID NO: 675 - DNA, 201 bp, Homo sapiens
ttctgttgtttgcatagatttttccaagactcgtagctctacttaagtgcaactgttctttctaaaggcacagcaaacccagtacctcttggtctctctcsatgccctgactgtcttgtaacctttttggctttgtctttctcatcttcctgtgagccttctgtacaatcagaaacacaacatgctccttcttccctgtcc

SEQ ID NO: 676 - DNA, 201 bp, Homo sapiens
catacatggtaacttaagcaggtaatgatcaccctatcagttgcaactggggtggccaagtacagagtcttgagttgactcaggacctatgactggttccrgctgcagaagtgggcactgaagactggaaagatcaatttatttgaggaggattgaaaaaaaaaagccatcaaattcaaatttcaaatccttcatatggtt

SEQ ID NO: 677 - DNA, 201 bp, Homo sapiens
gtgggtgtgggctctgcaggtgccccggtcccatggggtgtccagtcaggaggcctgcccgggcctccgccggtcctctccctctccttggggtagtcccygccctccagctctgaggagagtgtgaatttggagaccttagccacaggcgacacggaggctgacgagctctcagtgggactccagcggcctcgctcctgg

SEQ ID NO: 678 - DNA, 201 bp, Homo sapiens
gtcagctaccacagctgagattcagcgagctatctacactaagtgtaccaggagaaagggttccaccccatcctctaaggttgctcaaaggctgtctccartccataatgacacccctttttaagacccttcagcctccccactagtttaggccccacggcatggctctggaggcctcacctctctcattccctccatctg

SEQ ID NO: 679 - DNA, 201 bp, Homo sapiens
cttaaaaaatgaattcatcagggcctagaatcatcaccgtcctaagtgcctccttcagggtaccacagtgccagcccctgtcccctcccttcatctttgcrtggaagagatgggcagagctgggccctttagggtctgaggtacaactgaagcctcagaagaaccgataaaccatgtttcttgtttgccacacagaaatgg

SEQ ID NO: 680 - DNA, 201 bp, Homo sapiens
agggtgaccagcccctcataccctctgacctggattcattcatggaaaacaggcacaacctagagtccatagatagcctgtgttggaaggaagaggttttytgctaatccaatgggtcaaacagtgctgttcccccaagaagcctgggatgtctgccttgagccaggcctgtggcttaaccagttcatcagtgtcttccag

SEQ ID NO: 681 - DNA, 201 bp, Homo sapiens
aaaattaaaaaaaaaaatagtggggaggaagtgaatgcaatgcatacagactggctgcagagacccctccttcttcccctcctccctgactttttcctgcrgcttccagaacatgggaagcagaccctttaaccaagagggagactgagtcttcatagggattgattctgctcaagaagaaaggcaccactgttgaagact

SEQ ID NO: 682 - DNA, 201 bp, Homo sapiens
gtgcttctgtgtagggcacagtgggccccaatgggggcctgtcctgccctgggcccttgcctcccgggggtccaccatgtgaggtggccgcagaggaaatstgggacaatgagcttttggcagagggtttactggatgagggctgtggttcttcgctctcctgtcttcccttgggggcaacctccaactcagattctggag

SEQ ID NO: 683 - DNA, 201 bp, Homo sapiens
taggccttctctttcattctattggtttgcttccaatgtttggtgattttggttatccaatatatttatgaatgagggattatgttgtaaagttaggataygtattaggatacaggttctagctcctataacaaggacctaactgcaggagtggcttagacgagacagtttatttctgtcttatgtgcaatctgagtttaa

SEQ ID NO: 684 - DNA, 201 bp, Homo sapiens
tctctaacttctttttatcctgcaaagcctggcacaatgcctggaaatggtatagagagataacagttactgagtcctaaacctgtgccttccacatctcwtttaatcctcacactacaaaacaggtactattattatccctgttttgcagataaagaaacaggcttatggaaattaggtaatcagcatttttaacccaga

SEQ ID NO: 685 - DNA, 201 bp, Homo sapiens
aaagggtctgaggctcggtctgggctcagtgaagagttctgtgattaattagtgatgtctgcccttggcttgggtggggcagtactggtgcctggtgtttkctgtcctgccagagcaggtttggaagatcctttagtagttgtccttctactgggcagcagatcaaggactcaggccggtgttgcttccgatgtcctggaa

SEQ ID NO: 686 - DNA, 201 bp, Homo sapiens
gggggtctcagggaactttttataaaaagaaatgcatttagttcgtaaggcctgattgagataattccaagtctgttttctcagctcttaatccttcctarcactttgcattcattgtattaataaataagcctgttttcagcctagttagaaaaaaaaaggccagcctcattcattagaattctgcgttccctttggtta

SEQ ID NO: 687 - DNA, 201 bp, Homo sapiens
cgttagtggaagagattacagagaacactggctaggagccaaggcaagaaggctttggaaaggcatgtttgcctttgagtgcttaacttagagactcatgygggaaagaatctgtggatctctttgagaagctgcagaacagcagatacacctgaatcctattcatgttcatccagaaacgcagactttaaaacaaccttg

SEQ ID NO: 688 - DNA, 201 bp, Homo sapiens
aaatatataagatggcactaaggtatctttggggagaaacgggacctggttttgtttcgcaggtcctttgccatttgctgtttgatactggggaagccacrtaccttgtctgtggtccagttaggtttctccactctgcaggtagggctgacctacttccattggaggaaaaacctagagagaaagaatgtcaagaaaggt

SEQ ID NO: 689 - DNA, 201 bp, Homo sapiens
atgagtacattgattagcggcaggttgaagatttttttttttaatttctatttttaattaccaaagtgtatgtatctattatatgatattgtaatagttcrgaataatataaaaggtagaaagtcttacatctttgcctctgccaatcccccttctagaggctccacctttatagattagtataaatctttttgcgcctct

SEQ ID NO: 690 - DNA, 201 bp, Homo sapiens
ccagaaagaaggtgatggttgaagtgagtgaagataagcaggagcttgtcaggaagagatggagagggatatcccaggtggcaacacagaggtaagagaaragaacagaacactcccacaggcgacagcatggtaggtgcaaagggtatacggtgagcggtaaaaaatgaggtatgaccagaccatgaaattccttgcatg

SEQ ID NO: 691 - DNA, 201 bp, Homo sapiens
aattggaactggtaatcagtctttgggcaaatggagagtgggatccacagacagattaaaagggtgaccccaggatgatcccagaagctagtgcatgaagratttctgatttctgatcctgtttcttggcatgtgacttctaggccagttgtttcctctctgggtattttttgaaatgcacttttatgtcttgatgctgaa

SEQ ID NO: 692 - DNA, 201 bp, Homo sapiens
gatggacttacagttccacatggctgaggaggcctcacaatcctagcagaaggtgaaggaggagcaaaggcacatcttacatggcagcaggtgagagagtrtgtgcaggggaactgccccttataaaaccatcagatcttgtgatacttattcactatcacaagaacagcacgggaaaaacctgcccccataattcaatta

SEQ ID NO: 693 - DNA, 201 bp, Homo sapiens
gtgttattttaagaaactgccacaaccaccccaaccttcagcaaacaccaccctgatcgattagtagccaccaacattaaggcaagacccatcataagtaraaatggcccactaaaggctcaggtgatctttaccattgtttagcaatatagtattcttaaggcatgtacattgtttttagtcataatggtattacacact

SEQ ID NO: 694 - DNA, 201 bp, Homo sapiens
aaatggcaacagactcttttcctaatgtttacacgtaatggattgaactggcttagcatcatgctttacccatatttctgttgacagcctgttactgtgtrgagagaattgctggataagagccactgagatcaaagggatctttacaatgggcctttcagtatatttgttctgtaatcatggactgaaaacttactgagc

SEQ ID NO: 695 - DNA, 201 bp, Homo sapiens
aaacagtgtggaggttcctcagaaaactagaaatagatctaccatatgacccagcagtgccactgctgggtgtacagctgtacttcgttttatcggacttyaccatattacactttgccgatagtgtgtttattaaaaattgaaggtttgtggtaaccctgcattgcacaagccttttggcactatttttccaacagtatg

SEQ ID NO: 696 - DNA, 201 bp, Homo sapiens
ccactcaattttcatatctttaaaattaaattttcatataagtatatggaaccaaaatattattttcattcatttacctgccaccagagaggatgtcatcrgccaacccgcaaaggtggtgggatctaccagccatataactcttctgcatttgttccctccattgtaagtgagggtgctgatacctgcttcagaggattc

SEQ ID NO: 697 - DNA, 201 bp, Homo sapiens
atgttgtcataatagctaacccttctttagtgcttcttatagtctgggcactggactgaggtttatatgtgttatatcattaaaactcaatctctgggaaygactgttagtacttggtaggtatactattattattgtcgttttacagatgagaaaactgaggcccagagaaagtgagcaaaatggtgctgggggcgatta

SEQ ID NO: 698 - DNA, 201 bp, Homo sapiens
tttcttagtcttcttaagaagtttttcctttctgtcagggaggcagcagtgggggtggagggcagggaaggagggattgtttttacactgaccacagtaaratattactcaggctaattaaggcctagagaatggttaaacaagaaattagagtaaattatgtaaattctggccaccaatatgagtacattgattagcggc

SEQ ID NO: 699 - DNA, 201 bp, Homo sapiens
gaccctgtatggcagacacagctgaatgtgtgttcagagttccaagctcaggaatctgggagtggccagcctggaggttcattctttatctgtgacgaacrtctgaaccctcagcctgtcccaaggaccacgagccatacaggggatcatagtcctctgttttgggttaaatgaaggttgtcaggtggaggttgttaaggg

SEQ ID NO: 700 - DNA, 201 bp, Homo sapiens; identical to SEQ ID NO: 201

SEQ ID NO: 701 - DNA, 201 bp, Homo sapiens
aggggtctggcatgacactaagtcatcaaactgttacacgaggaaggaaaaagcctcgctgtattaaaccattgagatactggggtttcttgttgcatggmctaactgctgattagcctaaccctaatatgaggaccttcttctgaagcccagtgtccttaatttgaggtcttgacatctttgccaggttcccaactgtaa

SEQ ID NO: 702 - DNA, 201 bp, Homo sapiens
gcctaaccctaatatgaggaccttcttctgaagcccagtgtccttaatttgaggtcttgacatctttgccaggttcccaactgtaatctaggctcatcacycctcacatacctgactttgaggtttgtccaccttctggacagacctcccaccctggttaggctaagcctactgggttggaccttcagaacatcactgcct

SEQ ID NO: 703 - DNA, 201 bp, Homo sapiens
tggatgctgcctgcctccctgtcctccccaggtggggcaagatcatctaccttggcaagcacagtggagcatccagacggccagaggttcagaaagggctkcagcagaccgactcggtgactggctcatgggagagcagcacagcatccctggtcctgcaaatgcttaaaacagagagaatatgagggcaggcagatgccc

SEQ ID NO: 704 - DNA, 201 bp, Homo sapiens
agcgggaagtgtgtgtggcccgtcctggcccagggactcagcctcacctaccatgtcattctcgaaccacaggaagtaggagcagtagaaatccccctccyggaacagcagcgtggtgtagcccttctgcaggtatctgcgcgccagctggatcagagaccagacctggggaaaagacagcaagcatcaccactctcccag

SEQ ID NO: 705 - DNA, 201 bp, Homo sapiens
gaggcgccgacagccgaggagacctccgcctgctgtgccccgcgccccgccaaagtcagccgcaaacgacgcagcagcagcctgagcgacggcggggacgytggactggtcccgagcaagaaagcccgtctggaagaaaaggaagaagaggagggagcgtcatccgaagtcgccgatcgcctgcagccccctccggcgcaa

SEQ ID NO: 706 - DNA, 201 bp, Homo sapiens
cacagctaggaaatcctggagccaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgca

SEQ ID NO: 707 - DNA, 201 bp, Homo sapiens
agtaagtctcagcctcattttacccagcccctcttcaaagctccagtttaaataaacctctgacaaaagggtgagttattcaacagattaccagcatgagyaactgatgcttacctgccggggatctctggaagaccatgcatggcacatgcccagttatgcctgcaaaggagagggagctggggtatttgtccaccagct

SEQ ID NO: 708 - DNA, 201 bp, Homo sapiens
aaacatacctccagacactgctgtgagtgctgtgtctctgttaactcctggaattcacccatccagaggaaccaggatgcaagaggttaagaaacttgccrtctgggtttgggttccccatacaaggattcaaatagttgatttaggaagtaatcccgggaaaccctgctaaggtagtggggaactgaggcagggaaggac

SEQ ID NO: 709 - DNA, 201 bp, Homo sapiens; identical to SEQ ID NO: 206

SEQ ID NO: 710 - DNA, 201 bp, Homo sapiens; identical to SEQ ID NO: 207

SEQ ID NO: 711 - DNA, 201 bp, Homo sapiens
ccttcctctctgccatggaaccacagagcaagtcagcagttctccttcctaatcaaaaagcagcatggaggagaaggctcctttgccaccttcctttctgytttggatggtgcttttgcaatcatgaggagacaagcctggagatgaaaggaggcattctgaatatggtggagtggaagaagaagaaggcctgcctggggc

SEQ ID NO: 712 - DNA, 201 bp, Homo sapiens
acctgctctccctccagcactggcaggaagctggcctctctgccctccttctggagctcaaacacggccccatgatgtttgtaccgtggagcccccgcgaygtaggagaggctgcaggtcttgtgcagcacggccacagcgtaacctggggcaagggtggtgtggctgtgaacacaccgtgtgctcccacctggcctctct

SEQ ID NO: 713 - DNA, 201 bp, Homo sapiens; identical to SEQ ID NO: 633

SEQ ID NO: 714 - DNA, 201 bp, Homo sapiens; identical to SEQ ID NO: 634

SEQ ID NO: 715 - DNA, 201 bp, Homo sapiens
acaggaataggttaaacagaaaggtagggagccttttctgggaactctaacacctccggtgagttctcaccttaccttttgttagagaggagttgggaccrttcatgctgggagtcagatgtctggagaaatggcttcgtgtgatcgagtgaattcactgctggagaatttacctgttggccccagaaggagtttcacagt

SEQ ID NO: 716 - DNA, 201 bp, Homo sapiens
agcacggcatggatgcagggctgtaaatgaatggggcccgtgcctcagaatcccgtcagagctgccctggtgctcagggactgggaccctataggagcttyggaggccaggctatggcaccagggtttgagtccatcacagagaagcagacggagacattttggtccagtaggcccatgggaatctgtgtgtgagatgaat

SEQ ID NO: 717 - DNA, 201 bp, Homo sapiens
attccagcaaaaggaaaaacctcatcaaagaagaggaagcagagaaaagtaggtccaactacacctttagcaaccacagacaagaagttcacagctgaagraggagaggagactcctatagctcaggtaagcttgagtaagaggagcaggcttcaattcccacagaagaaactgccatggctcttccactctgtctctcca

SEQ ID NO: 718 - DNA, 201 bp, Homo sapiens
tgcagtcaacagcccgcggggtagccagcttcgagggaccgcccggaaagacacaacgcgcgtggaaggcgccgggcgtccagtctcgggagagattagargtggcgctcctgcccagcgccggcaatccaggggaatccgcggccatcgcggatccaccaggggtgaggcggcactgagcacaagtgtgaggctctcggg

SEQ ID NO: 719 - DNA, 201 bp, Homo sapiens
ttcttcagcacagtccacactctgggctgcctttctacagccttccattccctgtgttccagcataaggctctggtgtggctcacctccaggggcagttaygtgcccgtcagtttagcacagcctgcattcttccccgttgctcctaacacttagggactgtcatgaccatgtctgtattgttaaagtgttgaacaaacct

SEQ ID NO: 720 - DNA, 201 bp, Homo sapiens
ggctgcctttctacagccttccattccctgtgttccagcataaggctctggtgtggctcacctccaggggcagttatgtgcccgtcagtttagcacagccygcattcttccccgttgctcctaacacttagggactgtcatgaccatgtctgtattgttaaagtgttgaacaaacctgttctctgtatctgtgtcaccgtc

SEQ ID NO: 721 - DNA, 201 bp, Homo sapiens
gtgacggagcgagaccctgtctaaatatatatatgtatatatcccacagttctggaggctgggaagtccaagatcaaggcaccagcaaagtcggtgtctgrtgagggctggctctgtttccagctgtgccttcacatggtgggagcgcagaacaagtgccctcaggcctcttttataagggcactgatcctgttcatgaga

SEQ ID NO: 722 - DNA, 201 bp, Homo sapiens
tgaagcctattttatccaaggattgaccaccaaccctagtgattatctactgatttcccagaaggctgctgccgagaatctctggagattcggagatggayttctcagccacaaagtggaacaggatatcacctctatgctggggggacaggagataccgtttgtacacagctcgatactttggaagtttgtgattgtttg

SEQ ID NO: 723 - DNA, 201 bp, Homo sapiens
acaggtgtagggtttcctctacctctgcactactgacaatccaggcggggtaattctttactgtgggcaggaggaggggggaggttggcccggtattgccrgatgtttagcagcacccttggcctcagcccattagatgccagtagcaccctctccccagcacgttgtgacacccaaaaatgtctccagatattgtcccct

SEQ ID NO: 724 - DNA, 201 bp, Homo sapiens
ctcagtcaacattaattgcatgcctaatattttccaggtatagttcccaccctcaaggagttcactgtctattggggcaaaactttttaaaaaagaacgtytgtcctcggtgctgtgggtttattgcagggggtaggctggttgtggggaggcacagttaaggaagacttcccaatgtagcaatatttgggctgacttttg

SEQ ID NO: 725 - DNA, 201 bp, Homo sapiens
ggatggccgttcctcagaaggctgtgtcttacatgctcattttacaaacattttgggcatctcctctgggcgatgaactgggctaggtgctgggaatgcarcaacgaacaggtcctggtctcagtgcttacagtgctgacggagcttaggcacagttttccaggactggtcattagaaaaggctgtgtgtcagctttaaca

SEQ ID NO: 726 - DNA, 201 bp, Homo sapiens
agggacaagcttaagagaggatgcttttagaaaatgtttcttttcatcgtaaaagtaacgttaaccacactataggaagtttggaaaatagaaaaaaaacrgtcctagcatttcatttaatttattcgtcttttctttttctatacacttatgttcttgttttgaaataactgactttgttataaaatgagtacgtgttca

SEQ ID NO: 727 - DNA, 201 bp, Homo sapiens
gtttttatgggattgtgagaaactgaaaaactgtgactgctggagccattttcccacaatccccattttttaaaaatcccataaaggctctctcgtgagcrccgcacgttttcccttgtagtcacgagggtaggggctggagaaagcagcagagatagtcaaaaacccacagctacaaaaaatgcactcctaagagcaagt

SEQ ID NO: 728 - DNA, 201 bp, Homo sapiens
gcctgggtccttgaccctcggcacgggcactcactcctgccccctgcgtgctggtgggtggggctgggaggttcagggccttgcctcccagaaaatgcctkcacggcttcctcagtgggcactggccgtacctgggaggattgtggaggcagatcccaatgctggtgtattccctggacagaaaaccccaggatggaagat

SEQ ID NO: 729 - DNA, 201 bp, Homo sapiens
gaatatttattctattatgccacaaattaagcagaactctgcaaagtgatctctaaaaataagtctgaaaaataatcatctaattccagtagaggcctctyacactttttaaatgttaactccaggccgggtgtggtggctcacgcctgttatcccagcactttgggaggccaagatgcgtggatcacttgaacccaggag

SEQ ID NO: 730 - DNA, 201 bp, Homo sapiens
gttcatccatgttgtaccatgtatccgaacttcattttttatggccaaataatattccatttcatggacataccaattttgtttatccattaatcatttgstgaacgtttaggtcatttccaccttttagctattgcgaaaagtgccgctatgaatatttaggtacaagttttcatatggacatatattttcaattctcct

SEQ ID NO: 731 - DNA, 201 bp, Homo sapiens
atgccggaactcgtagtctcgggatgctgggtctcagcgcgtgatggggtaatggcacgcaggcctgcgttgaacgctgggactcgtagtcccgccatgcyctgtccgcggtgcacgccgggatacgtagttccgagcgcgccaagaccgtcactgggactgggcgacagcggcccgcgttgcatgccgctgctccacggt

SEQ ID NO: 732 - DNA, 201 bp, Homo sapiens
ggccgacagtttccaaaatgttagtattcagcctaacatgagaaaagtcaccatataaaagtgaggggggaaaagcaaatacaggataatctcaattgtayataaaatttatatacgtaaggacaaagatacatagtaaaaaaaaaattctggcaggtattaaggctgaaaaaattaaaacagtccagagcggtctggctc

SEQ ID NO: 733 - DNA, 201 bp, Homo sapiens
ctcgctctagaccacagtggcagtgttgaagctttccagccacggctctgtggatgtgtgcagtgttgggaatcaggctgggctgcccttgttccttcttyacattcctcagacgttgtgctttacagccacagtttcagtaaccgctgccagagccccacctgtgcgtgttctccaggatggctgcgtctgggctctggg

SEQ ID NO: 734 - DNA, 201 bp, Homo sapiens
ctgagtagtctgtccttacagtgtgaaccaggggttcatgggaattcttcaccatccagtagtctgtaaatgttgcccatgctgagtagtgtgtccttacrgtgtgaaccaggggttcatgggaattcttcaccatccagtggtctgtaaatgttgcccatgctttagttttgttacctggttgctctgtttttatgggat

SEQ ID NO: 735 - DNA, 201 bp, Homo sapiens
tgctgtcagtacgattattgcaactcctggtcaagcccccaactccagagctctctgccggagccccatgacaggcccctggccctgcctctgtctgactmccagattcagtggttctaccaggccctgaacctctccctgcccctccccaatttccatgctgggacggagcctgatggcctggaccccatggtcacactg

SEQ ID NO: 736 - DNA, 201 bp, Homo sapiens
agctctcctccctggggggcttgcggctggcctttctggggaagttgaccactcccagggtctggtcccagggctccgagggaggcaggcacaggtggcastgtccagtgttgggagctgggaacggagatccccgaaccctactcaagccaagagggctttaggggccaacctagagagtgggctttggccgggttctgc

SEQ ID NO: 737 - DNA, 201 bp, Homo sapiens
aggtgagatgagttagtcctgggtcttgggtggctgtcctaggatacacttcacattccaaacacaattactcatctttgctttctaagtgctaggcatarttttaagtgctagaaatagctagatgaaaacaaccaaaacccttgtcctcttggagcttgcaatataggggagaacaacagactatcaggcccctggcct

SEQ ID NO: 738 - DNA, 201 bp, Homo sapiens
tagctagatgaaaacaaccaaaacccttgtcctcttggagcttgcaatataggggagaacaacagactatcaggcccctggcctcccttcctccttcctcrgaaacacagacccaaagcccaggcctgaccttgccaacttgatataagcacaagacaagtgtctaagccttcactaaccttcactgtccacaagatcaca

SEQ ID NO: 739 - DNA, 201 bp, Homo sapiens
aatataggggagaacaacagactatcaggcccctggcctcccttcctccttcctcagaaacacagacccaaagcccaggcctgaccttgccaacttgatayaagcacaagacaagtgtctaagccttcactaaccttcactgtccacaagatcacaaccaacctcttctctggcattaaaagtctatgatctggctttatc

SEQ ID NO: 740 - DNA, 201 bp, Homo sapiens
cacggccagcttctcactccccatgctgtggggtgagattatacagaaaatgagcttgccaatggctggtgcaatggaatcttttgaccattcctccaccycaaggatgggtacagacgaggactaaacaaatttagggagctgaggttgagctgtgaccaagtcctggcctctggggaggaggctagaattttcccttag

SEQ ID NO: 741 - DNA, 201 bp, Homo sapiens
tggtctgaccatgcagtaagtgcaaacagcaattactcaaatgtcttagaatactggcaagaagcaccccaatattcaggtctgggaaacagccatgaccrttacggcctcttgatcagctccatgttccactcagtagcttatatgccccaagaaaaggcaagagacagacctggggtggggaaagaaccggggtaatag

SEQ ID NO: 742 - DNA, 201 bp, Homo sapiens
ccatccgcctcatcccctcactatgctctagccaaggttgactgaatttagttgcttaaacacctcaagtgtgtctgcccaccttggggcctcacacaatycatttcctctgtttggactcttttatgcttttacctaacaccttatcatttttcaagtcttgactgaaatgtccaaatcaggtcccctcatcttatccta

SEQ ID NO: 743 - DNA, 201 bp, Homo sapiens
tgttccggcaggaagatgacagagggattacctaccggatcccagccctgctctacataccccccacccacaccttcctggcctttgcagagaagcgttcyacgaggagagatgaggatgctctccacctggtgctgaggcgagggttgaggattgggcagttggtacaggtgactcttcatcccagatctgagtctgggc

SEQ ID NO: 744 - DNA, 201 bp, Homo sapiens
accgctgctcacagcggaaggccgagaggaaagcctttctgtagttgctgttcatccagccatagagaaggggattggcaaaagtggagcacatggcgatratgtggaacactgtgaagatgagtttgtactccttcaggtccaggacctggctgtcaatgtcaacggcaagctggaaggcatggagaggcagccagctga

SEQ ID NO: 745 - DNA, 201 bp, Homo sapiens
agcgaatcagcttcctgattattggcttggcctggggcatcagtgccctgctggcaagtcccctggccatcttccgggagtattcgctgattgagatcatyccggactttgagattgtggcctgtactgaaaagtggcctggcgaggagaagagcatctatggcactgtctatagtctttcttccttgttgatcttgtatg

SEQ ID NO: 746 - DNA, 201 bp, Homo sapiens
atttcttagtggatataactaggaaatatgaatgacattttggaactgtcaatattgtgatgtggtgctaatcttattcaaaacatggttgaacatggttkagcgattttgctactagtgataatcacttgtcctgatatagtcaccatctgctgtggtttgtatatttcctccaaaattcaggtgatgaaagttaatggc

SEQ ID NO: 747 - DNA, 201 bp, Homo sapiens
atgcttattcttagatcctattctattcttacagattctgaattgaaattctcatctgggcccaagaaactgcctggtaaataattacccttggtaattcsatgtagatggtgtctatgtatcacataaagaaatattctggtttaataatcaaaccagccaaaatgtgatggtgagaaaagatggaaggtaagagtaaaa

SEQ ID NO: 748 - DNA, 201 bp, Homo sapiens
taaaattcaccactttttctgtgatattcttccactgtatagactctcctgtacagatccttctattaatgaactaatgatatatatcttttcaataccarttcaaatctttaccattgctactgtcttgatctcttatctctgcatccttttgactgttttcaaaatgaaatccaaggagggaagaggtaaagcattttc

SEQ ID NO: 749 - DNA, 201 bp, Homo sapiens
agctaccaccactgcctgcaacacactggctaaccaggaggtctgagtctgtccacatgccgagttcactaccatcataatcaacattcaagaaaaacaamacactaaggctatctataatcaaggattctcacaaagtctacatcactcccctgccactcccatcacagccagtactggtaccaactgctgtggttttga

SEQ ID NO: 750 - DNA, 201 bp, Homo sapiens
caggctacagcctacactgtgaaacagccaaaaaactctaagtccccaaagtgtgagaaggggacagactgcatccaggatacacatccccatcagggaaygtgaaatccaggccatgggggaaggcctttaccctacccagagctgggactgatttagggaatagtgagaaatataaaagtagaggcagtagtggaaagc

SEQ ID NO: 751 - DNA, 201 bp, Homo sapiens
ttgcaatcagatctgtgctgaaaagcacatgctaacagcttatacaatagtaacaggaagacctatgaccttaattatagaacctcatttatctcttatayttctaaattctgtatgactaggtattgcaacatcttgatgcattatggtgaagaatatttccaccaagtaaaggaagctttctgtgacccactgactgat

SEQ ID NO: 752 - DNA, 201 bp, Homo sapiens
ttggtgaccttatctggaaagggttactaagctagcaaaagcattcttcaaatcactgtgtttctgtgcagtttttaaaatgtagacatttaaaatgcctwaagagtaattcattttaagcgtcacattgatccaataggatacgatttaaaacttgtttactttttcctggaggaaaagataccataagaaaatgtctta

SEQ ID NO: 753 - DNA, 201 bp, Homo sapiens
tctattatttttctgtttgttttgaaacgccttttttcttaggatcataatgatagcttattctatcagggataagggaataatgtattttgaaagccatwagtttgggacactatcttttgctggtacagtgacttgatatattttaatatatggcttatctatgacggttataaattgcatcttctgatcttgtaattt

SEQ ID NO: 754 - DNA, 201 bp, Homo sapiens
aatgctttgattttctatcttcctttaatattattttcatgtggatgtagtctattatttttctgtttgttttgaaacgccttttttcttaggatcataawgatagcttattctatcagggataagggaataatgtattttgaaagccattagtttgggacactatcttttgctggtacagtgacttgatatattttaata

SEQ ID NO: 755 - DNA, 201 bp, Homo sapiens
gagttcatcctcacaggatttacatatcatccaaagctgaagactgttctgtttgtggtgttctttgccatctatctgatcaccatggtggggaacattgrtttggtggcattgatttatatagagcaacgtcttcacacaccaatgtacatatttttaggcaacctagttctgatggattcctgctgttcctctgctatt

SEQ ID NO: 756 - DNA, 201 bp, Homo sapiens; identical to SEQ ID NO: 755

SEQ ID NO: 757 - DNA, 201 bp, Homo sapiens
agaaaaatggtagaaaagagtcaatttagataaaagaaagacacctaaaattttatgtaatgattttatatatttctttgtagactttcctttaaagctartagtctgcagaaaccaaagaatcattaaggatcattagtagaattcataaagcaactttactcattccaggtcatcagggtggagctaatactgaaatta

SEQ ID NO: 758 - DNA, 201 bp, Homo sapiens
tcggtttcatatgaatcagcaagatgatcatcaaacagactttagtgaaggtcatttgtttttacctcattatctcacaagacatctttaattaatttcargtggtttatatatttttaggactgagtccacagaattacactgatgtcagtgcagagaaatccctttaggatttggtggaaagctttaactttgcagtgt

SEQ ID NO: 759 - DNA, 201 bp, Homo sapiens
taataataatatcaaagtttccctgagggcattgtaggatgtgggaacaaattcacctcacagagtgaagaagttgatgaccttggccgcactttctacaytttcttggatcctctttaaatactaattattttctacaaagcatattagtcacacttcccccagtaacaggtcaaaccagcctgagactattttctgcct

SEQ ID NO: 760 - DNA, 201 bp, Homo sapiens
acacttccattgagaaatctttctttgttcctcgggtcactatgcactttcttctttatatttttataaaccttacttaccctttttttggccaggtgctrggattacacacccgtaatcccagcactttgggaggctgaggcaagtggatcatttgaggtcaagagttcgagaacagcctggccaacatggtgaaacccc

SEQ ID NO: 761 - DNA, 201 bp, Homo sapiens
tgcaacagaaaggaaagcttaaataaaactctttgcaagaatgcctattgagctacattttgatagcctctcagtaagtaacaactcagtatcagtccttkgttagaaattgccaatgtctttattccaacaaatggctccataaataattcttagtagcactgtcagggtacacatttttatctgtggaagttttaacaa

SEQ ID NO: 762 - DNA, 201 bp, Homo sapiens
aacatctttgcatcgctgggctatatcccacctaatcatggtatattatatttttgatgtattcttggacttagcatgctagtattttcttgaggattttwgaatctatcttcatcaggggtattcgtttctacttttttatagtgtctgtctgtttttggtaccagaggaactcttcttgtcataacttaagccagaatt

SEQ ID NO: 763 - DNA, 201 bp, Homo sapiens
tcccttttggcccaggatgtgtctaggaatgtcatccaggaaccaggccctggaaaaagggcctcacatctctgaccagtacactaacttatgtggctggrttggtatttaagatgtaagacaaagtcccccttactcttccctctcctctcctcaagtggaagaaaggaatctcttttagagccatgagctgtgcagcct

SEQ ID NO: 764 - DNA, 201 bp, Homo sapiens
ccagaagcatttattgacaaactcttctctaactgatttcttatgtctcctttttgtacatttatgctcatacattcacatgtacatgcatacacagagargtctatttctagcccgtttgtacaacaaaaacaagacggttctagttcgtacacttctgtctcaggagggaagatggacattttaaaaggcaatcaaact

SEQ ID NO: 765 - DNA, 201 bp, Homo sapiens
tcctcagttcttggtgaatttcatacagttcctaagatataaatttaacatatctgttatatgcttttttaaaacattcaatctactggaagaatatataraaattattttcttggagagagatgtgtgtgcgtgtgtgtgtgtgtatatatatatatatagccccatataatatatatattctatattatatgacatata

SEQ ID NO: 766 - DNA, 201 bp, Homo sapiens
taaataatattttttgactaccactagtacttatattacaatcagtgagattgttctattttagctttctctctttacctctacttattttgtttttactyttcatttacttttttattatgatgcattcatcataataatgatgatgccttacttacagagatttaagatttacagaggagtcacaaagatggtatggag

SEQ ID NO: 767 - DNA, 201 bp, Homo sapiens
agagacagtcactggaggactctatttggtcatcttgctctacctccctctacttttactttattgattttgtagctcaaatcattccaattttggccacygaagctatttccctcgcctcctgtgtgcttttgacaaacacccataattgtgtatatgggatgtgtttttgttggtttatttttggcacttttttattgg

SEQ ID NO: 768 - DNA, 201 bp, Homo sapiens
gctaaacaaaaatatcttttcatcacttaaaagtaaaaacatgaaagaaaactaatttatacacctatccacctatctgctatgcactactagactttttrtatatataaactaccgattaggccttaattcttacacatttcctcagtagaaatctcgtatcttgaaatcctgaatgtcttgcccaaattcattcagctc

SEQ ID NO: 769 - DNA, 201 bp, Homo sapiens
tgaatcaatattgccttttctttacatcctttggagtttagaaaaaggataacttttgtttcattaatcttttctgttattttattatcaaattcatttaytttgctccaatcttatttcttttcttctaataatttttggtttcattttctgttgcttttctagatctttaagatgcatcattaagttgtttatgggaaa

SEQ ID NO: 770 - DNA, 201 bp, Homo sapiens
caaagaaattcctctacttgttgtaaaaaggaaaaaaattgaaggaacaataatatgctctcaattacaatcaattacaatattataacccctcattcatytctcaacagacaaggtggagatgaataaggagaatcactccttgatagctgagttcatcctcacaggatttacatatcatccaaagctgaagactgttct

SEQ ID NO: 771 - DNA, 201 bp, Homo sapiens
agtattatcacagaagccagaggtgaagggactttcaatagcaccaaacactacagcttggttaggaagataggtagatgttctttgaaggtgacatttasagttcattgcgatcttactcagagaaaagtttcagtgaaatggtgagggcagaaaccataaatttgagggatctaagtagaacaatttgtaatctaactg

SEQ ID NO: 772 - DNA, 201 bp, Homo sapiens
tttttatctgtggaagttttaacaagcaatcatatgcatgggtcactccatggcttaacaaacggagaatgaaaaactaatgcagactagtgccactgtcrcttcataacaaatcagaaaataagcattggtcctctcctctaaacttaaactatagataaaaaaggaacttatcagcaggtatcaatcccgctgggtgtt

SEQ ID NO: 773 - DNA, 201 bp, Homo sapiens
ggaaaacaaatagtgtaaaagctggaggcatcacattaccagacttcaaaatatattacaaggctatcacaaccaaaaagcatggtattggtataaaaaarcagatgtacagatgaatggaactgactagagaaccagaattaaactcatgtatgtagaaccaattgattttcaataaaggtgccaagaacatacatttgg

SEQ ID NO: 774 - DNA, 201 bp, Homo sapiens
ggaagagtttgtgacttatatggagccagtgagacagaaaaggtgattttttcctgaaaaatgagttttcttattttaaaagagatccacaaaaaatagtytttctctctctgagtgttacggtatgcggatatgaaacccagcagagccaattccctttcaccatcaagaggaaaaccagcctggagttgtagtcaatac

SEQ ID NO: 775 - DNA, 201 bp, Homo sapiens
ccatctagttaagacaggttaaattctcctctagttcattctttgatttatttgattgtagttgggttggttctttgggggcttggctaagaagcatactytagtttctttgtattattctcttaatagtaaccattctaatctccctggtatgctgtgtcctctcaagaaccttaaatgcatgctcataaccatcaacaa

SEQ ID NO: 776 - DNA, 201 bp, Homo sapiens
ccccaatttaagtcagcccaaaaggcagagctataagttctcacttggatctgtcagatatctaagggcaaatcagtcaacatttctacagatagtagatmtattttcgcgtagtttataagtttggtatactatgaaaagaaagagggttcctcacctttggtggaacccccatcaaaaatgcgccccaagtagatgagt

SEQ ID NO: 777 - DNA, 201 bp, Homo sapiens
cagtgaatacaaacctgagagctccaaatagatacaatccacattaaaaagcagaataaataaacctgtcagttttcagaataataagtgttgtctaatarcctatgaagattattattttcaaaattatcactatgaattcatagattttaacatgttatcaacttaataaattataattattattctttgaccgatagg

SEQ ID NO: 778 - DNA, 201 bp, Homo sapiens; identical to SEQ ID NO: 748

SEQ ID NO: 779 - DNA, 201 bp, Homo sapiens; identical to SEQ ID NO: 752

SEQ ID NO: 780 - DNA, 201 bp, Homo sapiens; identical to SEQ ID NO: 763

SEQ ID NO: 781 - DNA, 201 bp, Homo sapiens; identical to SEQ ID NO: 764

SEQ ID NO: 782 - DNA, 201 bp, Homo sapiens; identical to SEQ ID NO: 768

SEQ ID NO: 783 - DNA, 201 bp, Homo sapiens; identical to SEQ ID NO: 769

SEQ ID NO: 784 - DNA, 201 bp, Homo sapiens; identical to SEQ ID NO: 773

SEQ ID NO: 785 - DNA, 201 bp, Homo sapiens
ccggcagtccctccctggtgcggccaccagcctaccttcagcccgataacattctgcccgtccacctcacacacgtagtggttggtgaggagcccgttgcrggccgcagaactccctttgaccagagagacaatcttccccttcttgatcacgaagccgacgtggcccatgctgtccttgtgcatggtgacagtccgctgg

SEQ ID NO: 786 - DNA, 201 bp, Homo sapiens
atccaccccaaaagcgaactgctctttctggtgcatcatggggacatgcacagtgacctgctcgcccaccaggaatgggaagttctttcttgtatattcarggtgaaagggcttctcccacttggctagcacaaagagagaaaagaagtctttatgtcaaagtacaattagtgaggcaaagacagcaaactgaaatgggga

SEQ ID NO: 787 - DNA, 201 bp, Homo sapiens
cagcttggacttttttgcaaatattttcattcaactcactttagaaacctgcagggagtctctctttgcaattccagaaaaatcagcatttttgtcaaagrcattttggatgcccatcttcgggaggatggtttccagattgtaggaggcagaaatggaaaatctggggatgaacacctctatccacctgtggagtaggga

SEQ ID NO: 788 - DNA, 201 bp, Homo sapiens
tctgtgctcagggacccacagagtcaagcaagttattgaattcagcataccgaattttatttattgccgctcaggagggtgggggcctgctgaaagacagrgtcggggcctgcctcctgcatccccggcccaaaagcccgggccaagaaggacacaggcttcaatggctgtcatgtgttgcagacaacatggtgttgagat

SEQ ID NO: 789 - DNA, 201 bp, Homo sapiens
gtgtgtgtgtccccaaacaactccccagatgccttgtaggcctgtgacactggtgttgagggagacattgtccatccctggaaccctctgctcaacagggsgacagtcagagacttgagcatccaacccccacttcctgccagctctgtgctcagggacccacagagtcaagcaagttattgaattcagcataccgaattt

SEQ ID NO: 790 - DNA, 201 bp, Homo sapiens
gccatttagaggaattgtttcaactgtgggtctcacaggcattgcccttgtcctcctcagacacaggtgtgtttgcagtggtgaacagccattccttgtcyttgctggggaagctgaccatcagtgctgcctttaacattgtttatatctacacctctgagctttaccctacagtcatcaggtacgtgtctcacacagcct

SEQ ID NO: 791 - DNA, 201 bp, Homo sapiens
agaaattggctctgtaacttggggttggaaatggtgctgcagatggtgctttctccagtgacagttctcttttccctgaattaggatcgattggcggcctsttctttgcagttggcattgcccaatatgccctgttaggatacttcatccgctcctggaggaccctagccattctggttaacctgcagggaacggtggtct

SEQ ID NO: 792 - DNA, 201 bp, Homo sapiens
tgcaaaaaagatttgacaggctgaaacaatggaccagatctaacaagattatgtttaatggggataaatgtaaagtcttaacatttggttaaaataaacargcaaataagatggaataagcagcagatgggaaagatgtggtttgataggagcctgtgtgaaaataatagagatgtttcagctgattataagcccagaatg

SEQ ID NO: 793 - DNA, 201 bp, Homo sapiens
taaaaggcacctgtacttttaaggcaaaacataaagggactttaagttatctttggcacaggatgaaaaatatgtccattgcttgagatcaatattgtaaytggcacaatattaacaaatggcagaaaacagattctttcagtatttatgtcccttccataattcctatcaaggaaagcaacttcatgttggaaaaggttc

SEQ ID NO: 794 - DNA, 201 bp, Homo sapiens
ttgttattgttttataattcaattctaatgtggccagaaaatataatctgtatggtttttatgttacccaaagttttcttggtgttaccatgggaacgaaratctactagaatcttttgcttgctaaccagaaacagctcttctactccctttactccaactaacttagcctcttcaaggcaggaatgatatcatactagt

SEQ ID NO: 795 - DNA, 201 bp, Homo sapiens
cctcaggtgatcctcctgccttggccttccaaagtgctgggattacaggcatgagccaccatacccagcctgctataacttttgattctccaaaacataaytactatagcctactgtttaccagaagccttaccaaacgcaagaacagtgattaatacacattttgtatgttatgcatattatctactgtattgttataat

SEQ ID NO: 796 - DNA, 201 bp, Homo sapiens
tggaagaggagtgtcacgtaggaatgcctttagcatcctctggccctgggagaaaacctggcagtgcacttgtccctgagtggtcctaagtgccttctggrtttgtgagtgagatgcccccccttgctccatcaccagaccttctgcaccccatagtgataaacagccttcccttctatgtcaacccacggccgtgtggaa

SEQ ID NO: 797 - DNA, 201 bp, Homo sapiens
ctcctggggccctgctcccagccaatgactgagtgtggcagaggcatagggcagccccattcctgggagagatggggctccctgacacctgatggcttaakgacacctaggtggccttgccaagtcttccttagacctaacagcaatgtagttcacttccattccaccttcttttcctcttgcctaaatctaggtcagact

SEQ ID NO: 798 - DNA, 201 bp, Homo sapiens
ctaactttttggaaagctgcccatttttaattcccagacctgtgtatatctaaaaattttagcctttcttcttgtctcttatagataaaaaatctatttasaatttaggctccagggatattaattttatattttatttaaatgactaatattgcactgccagagttaccactgctctttctacttggcacagatagcctg

SEQ ID NO: 799 - DNA, 201 bp, Homo sapiens
caaatggatccatccggtcaattatgacgaacatgtgaaaaaaatagaaacctatctaagatgatatattataactaaattgtaccatagtgatgacatcsatttgatttttaaaaaggcagttaaatacaaattgatatcttggagaaaagtacatagaaaaagtccacttgggctgagccttgacattggggagcattg

SEQ ID NO: 800 - DNA, 201 bp, Homo sapiens
caggatctggagtctctcaggtctgggctgaggaaaggaagaaggatcccaacaactctcaggcatcgagtctgctctgagactcaggagaaagtttggcrggagagtgggaaggagaggcagggctgtgtccagagagcggggctgctccagtgagctctccctgccccgtgggaagggcaaccaaagagaacagtggtg

SEQ ID NO: 801 - DNA, 201 bp, Homo sapiens
cagtggtgacactgaggacgtcagggagcagtcaggctgggagctggactggctgtccacatggaaactgatgtcactagaaaatgaacagggatactggsaggctggtcagttttcagtgagtttggggaaggacaggaagtcagtaagtgatggagatgaaaagggtggaagatggcagagcactgtgacacctacctg

SEQ ID NO: 802 - DNA, 201 bp, Homo sapiens
gcaattataagcaatatcttaagcaatatcaagttaaaaaaataaaatggtgctctcttttcatacttttctgagttggtttataaatcttgatgtccagrgagggaaaatgttgaaaggcatagaagacattgggaaatgggcagcagtgtgcaattcaaacttagcgatggaaaagccacactttggggaaaatcgccc

SEQ ID NO: 803 - DNA, 201 bp, Homo sapiens
catgtgtcattttgctttcagcgaattgtaatgtaccatagtctaagtgctataggatgtcactggtatggctggatttattaaagcaagacttaaaacayggaagaagctttacaatgcatttttaatgacataaggagtgactatgaacatcttttgtatctcagagaaatttactgatgaatgcataaaaaattactt

SEQ ID NO: 804 - DNA, 201 bp, Homo sapiens
aggatgtcactggtatggctggatttattaaagcaagacttaaaacacggaagaagctttacaatgcatttttaatgacataaggagtgactatgaacatsttttgtatctcagagaaatttactgatgaatgcataaaaaattactttgaagagctgttaacttagagatggaatttaacattcttctgttacaaaaaag

SEQ ID NO: 805 - DNA, 201 bp, Homo sapiens
ctttgggattttcttgacagtcatataaaaagtaaggacagtttttttttttccatttccaatctgtatgccttttgttttaccttattcctctggctagmatgtctagcactgtgctgaataaaatggtaagagtggacatccttgccttgattctgatcttagaagggatacactccgtctttcaccattaagtgcagt

SEQ ID NO: 806 - DNA, 201 bp, Homo sapiens
ctctggtagacaatggatagtggttgctgtttgtggctttaaggcccatctgctgatgggtgcaattttattaggcaaaaatatgtgggtgaatgtgtgcmtggtagttgtagataacagtggagagaagaacgagcgaatatttttgttttttgggggggaaaggaatactatgtgagctgtgtgaatttgtcacagcca

SEQ ID NO: 807 - DNA, 201 bp, Homo sapiens
aacagacatcacaattaacggaaaattttggaagcataagaaggatactggcaggtcaaggacactagctggtcgccatttctattcaatgttaaactagragtcatggtctagacaatggaatactatgcagctgttaaaaagacaacacataataaacaaaaaggcaaatgaggttaggaggtggaggcatgaggggac

SEQ ID NO: 808 - DNA, 201 bp, Homo sapiens
aaatatgtttgtgtatgagtgcacattttcctgtaccctcatatttctgagaaatcctataactttcattagctttgcaaaaggttcagggactaaaaaarggtgaaggaataatcttggctctggcagattaactgtaggagtagaaaaggaaacagaatattcaaagtcttgtgctggaacaaataactttcaggattt

SEQ ID NO: 809 - DNA, 201 bp, Homo sapiens
tctgccctaaacagccattgtttgtaggaagtttgagacttcctggtctcccacagagcagctggctagggctcaaaggatacaccttggtgtttcaggtycatctgtctgattggcgcatctgaccctgaggtgtaataatcctgagtctcactgaagcaggttctcataactctttttttcctcttttaaacccttcct

SEQ ID NO: 810 - DNA, 201 bp, Homo sapiens
catggaggtaagaggaaaacaaggagaatgtcatgaaacaaaagctacagaagcgagtgcttccagagcataggagtggttaacaatgttaaatgccaccrccaagaggtcaagtaagatgaaaactgaaaagtatcctttggatttagaagttattggttatctcaaaaaaagcagttccaaggtatgaaagaggcaaaa

SEQ ID NO: 811 - DNA, 201 bp, Homo sapiens
ggagcagatgtagtgcatgggctggaatcatgaggtcacttttgaacatagtatgtgtgagatatccaaaaagagagactgaggaagcagttgggattgarggcagggatctgaagcttagatgagaggtctgggattgagaatacacagggttgtttgtttttttttttttttttcagtgtaaaatagggggtaatggaa

SEQ ID NO: 812 - DNA, 201 bp, Homo sapiens
aacaaaaacattccagtttcccttcaagatacgtatggtgtgacagtcaataaatttatcagctctgctttattgtaaatattcatttattcaatatatarttagtatttaccaactatgtcctaggccctgtgctagattctgggcaaacaacagtgaacaaagtagatgttgtccctgcctttatttacaaataaattc

SEQ ID NO: 813 - DNA, 201 bp, Homo sapiens
aactgtgagtcaattaaacctgttttctttataaattacccagtctcaggtagttctttacaggtgcctgagaggaaacaaagttgaagttgttttgttgkcttacagtatactttctctcccttctaaaaaccaagttttgggtctaggagaaatatgaggcattaaacctagagttgaagtttgattagcatggaaaat

SEQ ID NO: 814 - DNA, 201 bp, Homo sapiens
aatcttcgggtaaggaatgctttgaagaaaacagtcttcagtgaaaacctcaggaaattaccacaaggcttaattaaatggagaatctacatggttttagraaaaggattatttgggtttttgttcaagtagaatacttcattctctgttagtgctagaaagtgaaatattgcctaaatttataataatattatcaggcag

SEQ ID NO: 815 - DNA, 201 bp, Homo sapiens
ctttctcatcaacctttaaaaaggaaacttgtgaactaatttgtctttcatctttttagttttcccccattcttcctcctgtggcctaactaatccaatakctagaaccaagagaaaagtgaaatagaaagcaagcctggataatccacaaacataaaaatcagacactgaagggtagaacttgatattttgtgctaaacc

SEQ ID NO: 816 - DNA, 201 bp, Homo sapiens
tatactcatatgtgaatcaagaggatggaagctggagttatgcccacttccacgtgggaaattttgcttacgttctccataactcagggctccactgatayagaggatttagaatcaaaggaggaatcatcaaggggaataaggtaatggctccactgaattagcagctgaattattggcctattttaggcttctcatgac

SEQ ID NO: 817 - DNA, 201 bp, Homo sapiens
tgaattgggtgatgcctactcatattggcgaggacagatcttctttactcagtcatctgagtaaatgtttctctctcccaaggcttgttcaataggctcaygaataaccatcacgggccccagtgatacagcaagtatattcataggcttaccatcatggattttgcttctgtccttgggaaagaggtgctattgtcactg

SEQ ID NO: 818 - DNA, 201 bp, Homo sapiens
attcaggagaaattatatcggtccaataaccgagtgacattgaacaaattgctgaatttctctttcctctattacaacagaaaataagtatgcacagaatrtccacatcaggcattttcttatgacaccctctccccaaattgagtaagatgtcactattagattctttcatagctccctgtgtttactcttctcatagcc

SEQ ID NO: 819 - DNA, 201 bp, Homo sapiens
tttggacctttgcatcttagctaatgcttgcctctctttccctctctgcaattcctcctattctctccctctttactggtgagttcaatcattgaatggcygggggaactgcttttatttaattctcacctccccagaaaagctttccccaaattccccatcacagacttctgaactcctagtgttcttttggtctgtgct

SEQ ID NO: 820 - DNA, 201 bp, Homo sapiens
tgtagcctccactcaaaatcaccaggcatgcaaataagcaggaaaatacctcccacaagtagaagaaaaatcaatagaaacaaaaccaaaaatgcacagaygatagaattaagagacaagaatattaaaacagctattataaatgtactccatgtgcttaagaatacaagcagaatacaagcagagaggccaaaagaaaga

SEQ ID NO: 821 - DNA, 201 bp, Homo sapiens
agtttcttttgtcataaatatacgtgatataaaatttaccattttattcacatttaagtgtgtagtttcagatgcattgcatacattcaaattgctgtgtwaccattgccactattcatctccaggacgctttcaacattccaaactgaaactctgttccattatgcaataattccctgttcccccctccttctggcgcct

SEQ ID NO: 822 - DNA, 201 bp, Homo sapiens
tctgagtaaatgtttctctctcccaaggcttgttcaataggctcatgaataaccatcacgggccccagtgatacagcaagtatattcataggcttaccatyatggattttgcttctgtccttgggaaagaggtgctattgtcactggctatcaccacttctgagcgaccaacttgttctcattgttaactaatcctggtgt

SEQ ID NO: 823 - DNA, 201 bp, Homo sapiens
aaaacaattatcagccaagaattttgtatccagcgaaactaagcatcatatatgaaggaaagatacagtctttctcagacaaacaattggtgagagacgtygatataccaagccaccactacaagaactgctaaaagaagctctaaatcttgaaacaaatcctggaaacacatcaaaacagaaactctttaaagcataaat

SEQ ID NO: 824 - DNA, 201 bp, Homo sapiens
ccgtaagcattcctcatgagtcaaaaatcctaccacagaactatccatgtttcaaaataaattaattttttacaaaacaaaattttttcttcaaatgctgsagctcttttaatctcttttatatgaaactttctttctctttctttttcttttcttttctttctctctttctctccttctttctctcttttcttctctcct

SEQ ID NO: 825 - DNA, 201 bp, Homo sapiens
aatagtgaccctcagtctccagcaggtgctccaagatgtatccagaacaacatggggagcagggcatggactgtccctgctgcacagttagatgagatccycatactgccaccccgtggcacctccaccctccctcagggctctttgggaactctggggtcatgatttgggatcaattatcttttaagcattccagatgct

SEQ ID NO: 826 - DNA, 201 bp, Homo sapiens
acttaacccaataacatccttgatagcattgtattttcctctcatgtattgaatccaattcaggatcacacatgacatttagttgtcatagttctttagtrtcttttgaccttcagcctttttttttcttttataacattgatatttttaagcatctataccttttctctttttcaaaataagaatgttcttcattttgga

SEQ ID NO: 827 - DNA, 201 bp, Homo sapiens
accgcttgccctggcttccacctggtgaaatccttatctaccctctaaggctcactttcagtgtcaccttccccgtgagtcttcccagccaactccccagkagaaaatacgcttttgttcctgttccagtactaatttatttgcacgtatgttacagactgttgtttgtggttcagctctaaaagttctttgaggtcagaa

SEQ ID NO: 828 - DNA, 201 bp, Homo sapiens
tcttaggagtcctccgtggagtgccccactcctaaaagttactatactaactttttgagggaccaccaaagcagcatttctgattgcaattcctgacgttwctcttcacttagaaacctccaatgattctcccacagcacacagaacacagtagagaccctatgagttacattcaggacctctcacacttcgtagcttggt

SEQ ID NO: 829 - DNA, 201 bp, Homo sapiens
aaaaagaaaatattcaaactttattttatatttaagttttagctaaaaatgagatgtgttactattatttaatacacaggttgacagtgatgacttcaccrtaccagtgtctgttggtcacaaaccacgtgtatactctgcagcaaggatgggctggcagtgaaaacctcatgtgtcattttgctttcagcgaattgtaat

SEQ ID NO: 830 - DNA, 201 bp, Homo sapiens
tttatgttaatttactaaaattaaaacatttgaattgattttaaagaagactattgagtaaatactagcagacagaaaatgggcatgtgaaaactagcaargggtactcagatgactgaagttagggaaaagctgagctagccatataattcttcccagttatgtaaagatatattctttactttcctgactctgattggg

SEQ ID NO: 831 - DNA, 201 bp, Homo sapiens
agccaggatggtcttgatctcctgacctcatgatctgcctgccttggcctcccaaagtgctgggattacaggcgtgagccaccatgcccggccgaccttcmtgtaatttcttattgctcattaatgtccttttttttcagattgaagaactctctttagcatttcttgtaggacaggtctggtgttgacaaaatccctcag

SEQ ID NO: 832 - DNA, 201 bp, Homo sapiens
atgaggcaaataaatgaagaaaatgagtttctgagacactgtttaggtaaccataaatcagacagatatttttatggtgggcaaattgatgaagatacttwtagtaggtgatttatattcataacaaatacatattgaaataattgtcactactgtatcagaattaaaaaccagcttcacattaggacttctccatacaaa

SEQ ID NO: 833 - DNA, 201 bp, Homo sapiens
cttgttcttgcctagaaccaaaagttcatataaatatttatgaatgaggctaggcgtggtggctgatgcctgtaatcccagcactttgggaggccgaggcragctgatgacttgaggtcaggagttcgagaccagcctggccaacatggtgaaaccctgtctctactgaaaatacaaaaaaatgagcctggcatggtggtg

SEQ ID NO: 834 - DNA, 201 bp, Homo sapiens
gggaacagattggaaaaagggaagtggaggtaaagaggtcagataatgggtgttgcaatactccaagtgagagatgatggtggactatgtaagttttatgsatcaacaagcaggcatcactcgtgtctctttttaacttctttttttttaactttttattgtgaatcagtttcagacttaccaaaaatataaaaatagcac

SEQ ID NO: 835 - DNA, 201 bp, Homo sapiens
tctaaaattcatatggaaccaaaaaagggcccacatagccaaagcaagactaagcaaaaagaacaaatctggaggcatctcactacctgatttctaactayactatagggccatagtcaccaaaacagcatgatagtggtataaaaataggcatatagaccagtggaacagaatagagaactcagaaataaatccaaatac

SEQ ID NO: 836 - DNA, 201 bp, Homo sapiens
gagtctggcagagtctggactactctgttcaagacacactctttaaagaagatttattttatagttaagcagggaaggtgaaacttattttttggactggrgcatgtctatgcctccctcctttcaagttgagagagcatgaacacaggttctattcactaaattaatccctcttgtagtccttccacttattagttcagc

SEQ ID NO: 837 - DNA, 201 bp, Homo sapiens
tcccctgtccctgtcagttactatctttctttcatttcgaggaatagaaaactatggggaatccctttcaggttatataaatttgctatttcttatcactrcaacctttgcctcctatgttcaagcaattcttctgcctcaccctcccaagtagctgggattacaggcacctgcaaccaatgcccactaatttttgtattt

SEQ ID NO: 838 - DNA, 201 bp, Homo sapiens
tctccttaaggtgttgagagtagtttctgctttctggactgagccctgatggataggttgctttccaagattattgtgaagtttactagagacactttatstaaacttgattcatgcttgggaagtgcttacttagtaaatactaatgttccttctcttataatttttatatacaaaataacagatgaaacctccagatgt

SEQ ID NO: 839 - DNA, 201 bp, Homo sapiens
aattgaatttgtagttaaaaacattcccacaaaaagaattctaggcccagatggctttactggtaaattctatgaaacgcaaaagaaatagcatcaattgwacacacttttccagaaaataaagaggagagaataactctcccggcttagcctctaagggcctgcaattactttggtacctaaaccaaacaaaataaaggc

SEQ ID NO: 840 - DNA, 201 bp, Homo sapiens
tggccatagccatggctactcccatgagagcctctaccacagaggacatggacatgaccatgagcatagccatggaggctatggggagtctggggctccasgcatcaagcaggacctggatgctgtcactctctgggcttatgtgagtctccaggggatgggagagagaagggctggttctggattgttgggaaactccac

SEQ ID NO: 841 - DNA, 201 bp, Homo sapiens
agcccaaggatgggaaaggtgtgtttgcagtggatggggaattgatggttagcgaggccgtgcagggccaggtgcacccaaactacttctggatggtcagyggttgcgtggagcccccgcccagctggaagccccagcagatgccaccgccagaagagcccttatgacccctgggccgcgctgtgccttagtgtctacttg

SEQ ID NO: 842 - DNA, 201 bp, Homo sapiens; identical to SEQ ID NO: 240

SEQ ID NO: 843 - DNA, 201 bp, Homo sapiens
gtgaggtctggtcaaaggcaactttagctcttccatttccactcaaaggatctgtaatgttctaatttttcaaaaagaaaagtaggcttgaggagtaatcrtaatataattaatttcaaagtaatttttttttttttgagatgaagtctcgctctgttgcccaggctggagtgcaatggtgcgatcttggctcactacaac

SEQ ID NO: 844 - DNA, 201 bp, Homo sapiens
cccaccatcaacaggtactttggtcaataatgtccgactcccaagaggtcacaggctggaattgagtgatggagacctcctgacctttggccctgaagggyccccaggaaccagcccctcggagttctacttcatgttccaacaagtacgagtcaagcctcaggactttgctgccattaccatcccacggtctaggggaga

SEQ ID NO: 845 - DNA, 201 bp, Homo sapiens
tagctatttattctatttaccttcatacatctagctaacatacactgccatttctgaccttatctactgattttacagtgtagcagctgaggatttagcaytcttaaatatttcccttccaatattgttataagataatttggggtaaaattgacattcaggggaaaaaaatcaagactcaggattacatcgttaaaatta

SEQ ID NO: 846 - DNA, 201 bp, Homo sapiens; identical to SEQ ID NO: 737

SEQ ID NO: 847 - DNA, 201 bp, Homo sapiens
cttgctacagattccaaagttggaacagctcccaggagccaacatagaaccaactcctgggaatgataccacttatcaagttaggaaaattacacttggcraatctattagaaacatatctagcctaaactcaaaaagaactctgtgaattcaagtgtcacactagtttaacaatcatgaggggattaggagaaagattag

SEQ ID NO: 848 - DNA, 201 bp, Homo sapiens
agggactagtcactgttattttgttcaaagagttaacatgtattaaataatttatacatgccaggcactgtactaaataagtattttatatttcatcctcmcaacatccttgtgaggtcaacattatatcaacagcatttgccacaattaatactccttccttgaaactctttccttttcattacaggccagcacgttctt

SEQ ID NO: 849 - DNA, 201 bp, Homo sapiens; identical to SEQ ID NO: 738

SEQ ID NO: 850 - DNA, 201 bp, Homo sapiens; identical to SEQ ID NO: 739

SEQ ID NO: 851 - DNA, 201 bp, Homo sapiens; identical to SEQ ID NO: 740

SEQ ID NO: 852 - DNA, 201 bp, Homo sapiens
aaggcctttgctgatcccttctaaaaataaccaagagcatttggctatttgggcttcatcactaccagtctattaacatcatattaaaaattactaatatyataagctatgtcaaaatctcattaatgctgctggaaagactggcaataaatactcttccataaagtacacattgtatgttttatatggctataaagaagc

SEQ ID NO: 853 - DNA, 201 bp, Homo sapiens
ctgagattaaattatatccctgcctaggaataattctattcccattatcctactataacaaaaacagttaaagtaaaatatgataagctacatttcctgcwtgattaaggctttccaaactatgatgggtactagcaggaattggctaactatggccaactacctgtttttataaattaagttttactagaacatagatat

SEQ ID NO: 854 - DNA, 201 bp, Homo sapiens
gctgtcattcctataaggcaagaatttcttaacccttctcatgtcatttgctcctgtaacacatattcaggagattgaagttaaacatgaaggctctcaaratgtatgagttggctgggcacagtgcatgcctgtaatcccagcaccttaggaggctgaggtgggtgactgcttgagctcacaagtttgagaccagtctgg

SEQ ID NO: 855 - DNA, 201 bp, Homo sapiens
ccaccaactgaaaagtatttggtgaatgtcatctaagtttcaaggactgtgctagatatttttaataatttattttttattatccttaccatatagttgtkctgccaagtcaaattataaggcaattaaacctagaagtctcgaaagacctatgccatcaaggcctttgctgatcccttctaaaaataaccaagagcattt

SEQ ID NO: 856 - DNA, 201 bp, Homo sapiens
tgcctcggcctcccaaagtgctgggattatgggtatgagccaccaggctggcccagagaacttaaataacttgcctatgattattcaactagtaaatagtrcagcttggatttgtatccaagccttgtgacctaaaagcctgggtttcttctaccctaggagtgtacatttatgtagggaagctaaagcaaaaaaagcttt

SEQ ID NO: 857 - DNA, 201 bp, Homo sapiens
tagtacacaactcattctcccatttaacagtatctttttaaaatttattttcattttttacaacaggtagaacccactatcaataacttatcattctcacrcctcccttaggttattccattagctttctaacctgttttcttgcccccttttgcatcttgaaaagatttagccctcattccaatccattttccacaatat

SEQ ID NO: 858 - DNA, 201 bp, Homo sapiens; identical to SEQ ID NO: 741

SEQ ID NO: 859 - DNA, 201 bp, Homo sapiens
cctttaaggagatcacaatctattaagggacatagtcaaacaatatcatataataaatattaaaatatagttatgtgcaggtaggacaacaccatgcagcracaaggataaagctaaactgtggaggcatgtcagaggaaatgcagagaggaaataaggagtcagaaaggatgacctggagtagcaggaaagtagcacgaa

SEQ ID NO: 860 - DNA, 201 bp, Homo sapiens
acaacatggccaagagaatattgcattatgatcactcattactgtcatttccaccacaacctgctttaaaatatgcaacttaacacagattttaaaggatsttcttctctgtcggcaaaattaacacaccagcccttccaatgaattcacatttcagagaacaatcacacatgcagggaatgcatcaaatacttttatgct

SEQ ID NO: 861 - DNA, 201 bp, Homo sapiens; identical to SEQ ID NO: 742

SEQ ID NO: 862 - DNA, 201 bp, Homo sapiens
atatgttagattgccttatagttcccccattaataatcaaacggtactatttatataagccttgtcatgatggtatcttaggccatttggctatgaggtgyctgttttgtggcatggccaacttcctctgaaagcgactcttttctaacctggtcacacagcaatttggacagcaagagagtgctacagagatcagctgat

SEQ ID NO: 863 - DNA, 201 bp, Homo sapiens
tataagctacccagtctatgatatattcttatagcagcataaatggactaagacaactgcctaggctaaagagtataggttcttcccacatatccctatakggtctggtaggtaccaattcaggcacagacaagcacataaacatatccatacagagaatattctggactggctctagggaatatgtacctctctctgagg

SEQ ID NO: 864 - DNA, 201 bp, Homo sapiens
aatgaaatgataaggttggaatggatggccagtttggggaaggtaaccaagctaagctgtactgcaaacactagcaaaataactgagtggaaaaaaagaawatgaactataatgagtaacaactattaatatacagagagatctgagagttaacagcatgggataacagatttttaaaaaacagtttctaaggaagggcac

SEQ ID NO: 865 - DNA, 201 bp, Homo sapiens; identical to SEQ ID NO: 593

SEQ ID NO: 866 - DNA, 201 bp, Homo sapiens; identical to SEQ ID NO: 244

SEQ ID NO: 867 - DNA, 201 bp, Homo sapiens; identical to SEQ ID NO: 609

SEQ ID NO: 868 - DNA, 201 bp, Homo sapiens; identical to SEQ ID NO: 610

SEQ ID NO: 869 - DNA, 201 bp, Homo sapiens; identical to SEQ ID NO: 612

SEQ ID NO: 870 - DNA, 201 bp, Homo sapiens; identical to SEQ ID NO: 632

SEQ ID NO: 871 - DNA, 201 bp, Homo sapiens; identical to SEQ ID NO: 245

SEQ ID NO: 872 - DNA, 201 bp, Homo sapiens
accctccataaatgtgtgccaagagggtctcctttcctgtcttcctctacagagaatgctgctcggtcctcctacccctcttcccgaggccctgctgccaygttgtatgccccagaaggtaccttggtcccccggaaggagagaaaaaagagagatggactgtggctgcatttcttgggtccttagagtgggctggagaga

SEQ ID NO: 873 - DNA, 201 bp, Homo sapiens
gcatggccacacaattgctgccttggttgtgaggaaccgtgcaagtcccacatcatgaccatcctgtcacgagaggcactgaagaactggctggatttggraatacaggctacctgctcagggaaaaaacaacaacactgaaatagctctggtatgctagttggactggactttaaattgggggaaagatgagtctgcata

SEQ ID NO: 874 - DNA, 201 bp, Homo sapiens
ggactacggtttttagcgccggaacttacaacccgaagttctgctgcttgtgactgcctgccggagagactggcatggtggcgaccagctggggagtggtscaccacccctttttttggccgcctctgaagtccctgtacccccaagctcctccgttagcggctcgggccgaggctccggaatgtttgccgggcgtcatgg

SEQ ID NO: 875 - DNA, 201 bp, Homo sapiens
actgcctgccggagagactggcatggtggcgaccagctggggagtggtgcaccacccctttttttggccgcctctgaagtccctgtacccccaagctcctscgttagcggctcgggccgaggctccggaatgtttgccgggcgtcatggcgacggtggagccctggctcaacaagcggccgcgcggttggctggcggcacg

SEQ ID NO: 876 - DNA, 201 bp, Homo sapiens
ctagcacttgttatgtgactctttgattctagccatcttagtgggtataaagtgaatatttcattgtgggcttgatttcaatttctctgatggctaacaaygtccaccatattttcatatgctttttgatcatttgtatatattttcttgagaaatgagcattcagattgtatgatgaataattatttgtctttattaatg

SEQ ID NO: 877 - DNA, 201 bp, Homo sapiens
atatttcattgtgggcttgatttcaatttctctgatggctaacaacgtccaccatattttcatatgctttttgatcatttgtatatattttcttgagaaaygagcattcagattgtatgatgaataattatttgtctttattaatgaattgtaagagttctttatatatgataaaagctcttatcagatatatgtttcaca

SEQ ID NO: 878 - DNA, 201 bp, Homo sapiens
taatgaattgtaagagttctttatatatgataaaagctcttatcagatatatgtttcacaaatattttctatttctgtgggttatcttttcactctgtatrtgcttttgatgcaaacatttaaaaattttcataaggtcaaatttgtctactttttcttttgttacgtatgctttcagtgtcacatgtaagaatcctatgc

SEQ ID NO: 879 - DNA, 201 bp, Homo sapiens
tcatttgcaagtcctaatagtattttagtgaattccttaggagtctgtatatataacatcatgtcatctgcaaataaagatgtttttacctcttactttcygaactggatgccttttatttctttttcttgtctaatttacatgcctagaacctccatgataatgttgaatagcaatgcaaggacttgtcttgttcctgat

SEQ ID NO: 880 - DNA, 201 bp, Homo sapiens
aagtcagagagaagtggcttgacttcagagggacagcttgatggtgtagctttgaagaggaatctggctggggacggctgaacttcaggggaagattaccytcccgttctgtccccttttcagctcctcttcccactgagaaccactttcacacaataaaatcccctgcatttaccagcttcaactctcatgcgacctcat

SEQ ID NO: 881 - DNA, 201 bp, Homo sapiens
gtgggcagcattacgggcagcgctaaggaaccatttaaagtaagacaagtccacacagctgtgtgcttttctacagtcttgttcaactgctgcataacaayagaatgttggaagcaggaattagttttaaagtaagatggtattgacgagacgacaataaaatacctctactacagagcacagcaatgttcggcctggtgg

SEQ ID NO: 882 - DNA, 201 bp, Homo sapiens
ccccagagtctaaattgttataagtacagtattttcttggtgcattttgagaggtacctttttggattgcataacagataggtttatatagtatatatatrtatgttacttgtatttgaatcaggtgttggtactgaataaaaggttatatttcttaggtatatgtaaattgccaaagaagtttgttcattggttcgttta

SEQ ID NO: 883 - DNA, 201 bp, Homo sapiens
gagggaactaaaaaatctaatatgtaaaagaaattatgttaacttttttgttttaaaaattaaagatggttgcgttattgtaagataaaggaaaaaaataytttgattcactaatcatttcctaatattttctaatgtatgttttagttttcttaaatattttatcagttggagaatggaatgttttgtgggaacgcatgg

SEQ ID NO: 884 - DNA, 201 bp, Homo sapiens
accttctaaaaggacgctctcctagtcacacttgaaggaaattacaggatagttgcagttttactaactgcaaaaataagaggaaaatgagagaaaaaatragaggaagaaatagttaatcctttgggttttataaggaatgtactagggacctttgggaacgaacaatttgtcttgtattttagcgtttgtaaacacgta

SEQ ID NO: 885 - DNA, 201 bp, Homo sapiens
ttgctaatttttaaaaattgggttgtctcaatattgctttgaaggttgtttatacattctagttataaatattttatcaaaatatgctttgtaaataattytccccattgtgtcacatttctttgcattctgttatcaatgtctttcaaagagaaaaagttttaattttgatgaagtccaatttatgaattttatctttta

SEQ ID NO: 886 - DNA, 201 bp, Homo sapiens
cacctgccctcaaggacaactactttaccagagcctaactagagttttatcagggcctgactgacatgtgggaatggaaatacccaactctggcccccaayagccatcttttcaccccaaagaaaaaatgtactgaaaagcacttgtcaagtctcatcccagggacaagggcccattaaaacactaagagctaatcatagg

SEQ ID NO: 887 - DNA, 201 bp, Homo sapiens
gcctgagacccatccctaggtaagtaactgacttggggttttccttggctcaagttaagattaacaaccagctggtcttaatttctcctcacaattagagygctcagtgatgatgttgttggggatttttgttgttgtttgttctggtttgaagttgctgtttaaggatcctaattctagttcaaagatgcattctacaaa

SEQ ID NO: 888 - DNA, 201 bp, Homo sapiens
gaagagtttctgtgtggtacagacttctggaagctgcccaagattggaatatggcttctgcccactgtcaacagcttgaagctggaggaggtcacagctgyccaggatgaccttcccaccttccctgcaagtgaaggggttctctgacaggtggactttagagctcttcataagtgcgtccctgtccttgtaccatctaaa

SEQ ID NO: 889 - DNA, 201 bp, Homo sapiens; identical to SEQ ID NO: 749

SEQ ID NO: 890 - DNA, 201 bp, Homo sapiens; identical to SEQ ID NO: 750

SEQ ID NO: 891 - DNA, 201 bp, Homo sapiens; identical to SEQ ID NO: 751

SEQ ID NO: 892 - DNA, 201 bp, Homo sapiens
gctaacaaatgttcataaaaataattatctgatatcttaaggtgacaataggatgcaaattttgagggtgtagaaagggcttattggatgtggtctacatrcagctggcttgggtcagggaaattaggctgggagggggaatgagaacatttccatttacattatggatatcctgggaatctatagtggcttcgaggcttt

SEQ ID NO: 893 - DNA, 201 bp, Homo sapiens; identical to SEQ ID NO: 755

SEQ ID NO: 894 - DNA, 201 bp, Homo sapiens; identical to SEQ ID NO: 755

SEQ ID NO: 895 - DNA, 201 bp, Homo sapiens; identical to SEQ ID NO: 757

SEQ ID NO: 896 - DNA, 201 bp, Homo sapiens; identical to SEQ ID NO: 758

SEQ ID NO: 897 - DNA, 201 bp, Homo sapiens; identical to SEQ ID NO: 759

SEQ ID NO: 898 - DNA, 201 bp, Homo sapiens; identical to SEQ ID NO: 760

SEQ ID NO: 899 - DNA, 201 bp, Homo sapiens; identical to SEQ ID NO: 761

SEQ ID NO: 900 - DNA, 201 bp, Homo sapiens; identical to SEQ ID NO: 762

SEQ ID NO: 901 - DNA, 201 bp, Homo sapiens; identical to SEQ ID NO: 765

SEQ ID NO: 902 - DNA, 201 bp, Homo sapiens
aacagcatggtactggtacaagaccagaaacataccaatggaacagaataaagaacgcctgaattagaccacacacctacaaccatctgatctttgacggwtctgacaaaaacaggcaacaggtaaaggattactttttcagtaaatggtgctgggataactgggtaatcatatacagaaaattgagcctgggctccttcc

SEQ ID NO: 903 - DNA, 201 bp, Homo sapiens; identical to SEQ ID NO: 770

SEQ ID NO: 904 - DNA, 201 bp, Homo sapiens; identical to SEQ ID NO: 771

SEQ ID NO: 905 - DNA, 201 bp, Homo sapiens; identical to SEQ ID NO: 772

SEQ ID NO: 906 - DNA, 201 bp, Homo sapiens; identical to SEQ ID NO: 774

SEQ ID NO: 907 - DNA, 201 bp, Homo sapiens; identical to SEQ ID NO: 775

SEQ ID NO: 908 - DNA, 201 bp, Homo sapiens
ccctctctccataaaggccactagaaagtactgtgatgccaggctgctccacatccaggcagcctgggtgaccactgccctttatgagaatcagaaaaagstgtctcccgagtagttggaattacaggtgcatgccaccatgcctggctaatttttgtatttttagtagagatggagtttcactatgttggccaggctgct

SEQ ID NO: 909 - DNA, 201 bp, Homo sapiens
atacagtgactatcagaccttcagctaattcaggcatgaagtcccaactgtccctgggaaaacagaactaaaaatggaggcatcactcctaagtgagcagygaagcttaagcaaagacaagaaggatacataactgtgtatgagagttggctaatggcatcagaagactgagataacactgaagcagactttgtacccaga

SEQ ID NO: 910 - DNA, 201 bp, Homo sapiens
agtaattcacaaaatacaaaggaacccaacaattttataggcacaaaagtgtgtgggtcacaagaatatcttgttcaaaatgtcaccagatgaaatgatgsagatttgtttcttttaatagttttaactagggaataacacagtaaaatatatgaagcgtacttctgtaaatcgtgcagcttggataaatttgagcacaca

SEQ ID NO: 911 - DNA, 201 bp, Homo sapiens
ctcaacacaatagaaaggagacagagctctgaacctggaagggaggctacagttccatgcaggcaggtcattagagctaaaaaatgaaaaaaaattcctakctaccactagcacacacttgttagaagctacataggcatcaaaatctcatttaaggatgagagattgttaatgcggttatctcaaaagtaattcacaaaa

SEQ ID NO: 912 - DNA, 201 bp, Homo sapiens
tgtgattttctatttcccagtggttccaaaagctgatagatttttctttttgcaaaacatattgcaaatatatgtttctaaaatctccccatgttgacatwtgacaaatagtgagtcttataagaacaaatctcctacagatttacagacaaatagaaagatatatccacatggcttattaaatacagacaatattagtct

SEQ ID NO: 913 - DNA, 201 bp, Homo sapiens
tctttcttatttataatgttccattgtttatgaataaaccactttatttttattctccttttgatggggaaattttatttcattgtttttttcctttgctrcggcattagggattgaagcctctgtgagccttcttatacgtgtcctttgcagacttttacagttctttctgctgcatgcacacaggaagagagtctctgg

SEQ ID NO: 914 - DNA, 201 bp, Homo sapiens
atcaccttcagcataaaataaaatatgtttacgtaagtgcattcaaagagagaaccatgtcctaaggcatcaacagaaaagggtaagattgagtgttacgrtagtctgaatgtggataatgatgcatagtgactgacattgaagagacaattaaaacgaatctggccataaaaagatacacaagaatatatattttatttt

SEQ ID NO: 915 - DNA, 201 bp, Homo sapiens
aatgccccaaacatagaatgttcaggacccatgtcacaggagaaatgtccactgtaaggattcgcatgaattactgtatcttcctggggtccatccaatgygtccatcaatacgaggaaagaaggccatttcactgggcatggaggaaggttgacagaccgtgcattgacaaataccaagtacttgttctctctctctctc

SEQ ID NO: 916 - DNA, 201 bp, Homo sapiens
ggaataacactcacctgatcacggacctagtttgagcctggacagggtgtcctagtcctctctgtgctcactttttatcctatcacctgtttataaggaaygaaagaacatgccatgcccagtcctggcatctgggattttgggactctaggatgtaagctttggagggcttttggttactcactcattatcattttgtat

SEQ ID NO: 917 - DNA, 201 bp, Homo sapiens
cttcagaaaagaaaaagaaataacacatttcccaaagcccaacatatacaccaaatcccagtgtgcctgccactccccttggctggatgctggaggcctgktctccacgtctctctccccttcactctgtagttgctcttgggacacagttgtaaaacccacacaaggtttcttggaaagacctgaactaaacagtttcta

SEQ ID NO: 918 - DNA, 201 bp, Homo sapiens
aaagtaaaaggagtttgtcagccagtgtttatctaaattaatatttattgcagaagaccaactttcacccacccactcttcactaatttgtatgaaaaackcacacagacaataatgggaattccgctggcatttttctggataactatgattttctcacatcttttgaagaaatggaatcatctaagacaacacttctgt

SEQ ID NO: 919 - DNA, 201 bp, Homo sapiens
gagcagtaaggttaaattaacctagcacatgcttgatacagactaggtgtgaaatttcactttgattcctttggctttaaagaatgcataaattagtgtgkgtggaggcgggagaagggggggaatgccaagtcccccgttttgttgtgctgggtagacacaatatacctcttcccctttaagtgaaataagtcttcaaat

SEQ ID NO: 920 - DNA, 201 bp, Homo sapiens; identical to SEQ ID NO: 621

SEQ ID NO: 921 - DNA, 201 bp, Homo sapiens
tatggtagccactagccacatgtgactatggagcacctgaaatgtggctaatgcaactgaggaacagaattgttcattctactgactttggtttttttttktttttttttttttaagacggaatctcgctctgttgcccagtcaggagtgcagtgactcaatcttgcttactgcaacctctgccccctgggtccaagcgac

SEQ ID NO: 922 - DNA, 201 bp, Homo sapiens
acagcctctgctctccccaagttctcagtgccacttgcggtacttggagcaggggtgctccgggagtctgcagaggaagagcgacccatgagagaatcagragggcttcctggaggaggccaccccagcgctgatactgaggatggattctggagcacagaggctccttcagcgcgggcttcttcactggctggacctgcg

SEQ ID NO: 923 - DNA, 201 bp, Homo sapiens
agttctatctttttcctgcatcctgtctggaagttagaaggaaacagaccacagacctggtccccaaaagaaatggaggcaataggttttgaggggcatgrggacggggttcagcctccagggtcctacacacaaatcagtcagtggcccagaagacccccctcggaatcggagcagggaggatggggagtgtgaggggta

SEQ ID NO: 924 - DNA, 201 bp, Homo sapiens
ccattaggtgaatagttgtttggggatctgggccttggtacagtatcaaataacaccagaaactactttctggtttcaagggggaaaagaacaactgtggratcagactgtcacgacgctaatcctatggtaaatctaaaatcattaatgaggccaggtgcagtggctcactcctgtaatcccagcactttgggaggccga

SEQ ID NO: 925 - DNA, 201 bp, Homo sapiens
tgaaatagcgttgaaggagctgactttgactcccggagatgaaggagaaagaggaaatcagaagggaccaaggatggtgaagttcttaagagaaactgagkaggaagagaggatgatgtggtgggagacgtgtagagagtccttgtagatctgtcatattgaaggggactatggtcccagaggtacagatgtcctaaaaca

SEQ ID NO: 926 - DNA, 201 bp, Homo sapiens
ctgtgtttgtactgtgataactggtgcttgaagggaggacatatagttacatgttgcgggaaaacacatgtcattagaaaacttggcatgatttagggacmattgccttttccatggtagatgtgggactctctgtcatcttcaccttgttgttccaagtgcagaagagaaagcttcttcctgctttcagctgcgtgactg

SEQ ID NO: 927 - DNA, 201 bp, Homo sapiens
gcaggggcagtgcaggtctgtggtcactcctgctctcacctgcggcgtctcccgtggagggattgtcacttctggttccctgtgggcaggaatggtttccwcgtaggtcactggggttttggccaggaaaagggtatgaaattcatgtgccagtttctcaaaattcctgctttcaatgttgatgtccaataaagatgttcg

SEQ ID NO: 928 - DNA, 201 bp, Homo sapiens
ttcccctgcctcagcctcccaagcaggtgggactataggtgtgtgccaccatgcacggctaatttttgcatttttagtagagagagggtttcatcctgttrgccacattggtcttaaactcctgacctcaaataatccacacgccttggcctcccaaactgctgagattacaggtgtaagccattgtgcacttggccagaa

SEQ ID NO: 929 - DNA, 201 bp, Homo sapiens
tcgatctcttgacctcatgatccgcccgcctcggcctcccaaagtgctgagattacaggtgtgagccactgcgcctggcctcatccactatatttgaaccracccaaaggccagtgctttcttaattaagttcccacaggtgaacaaagccaaaattcagattctattttatttatggtttagaattacctactgtgaaaa

SEQ ID NO: 930 - DNA, 201 bp, Homo sapiens; identical to SEQ ID NO: 924

SEQ ID NO: 931 - DNA, 201 bp, Homo sapiens; identical to SEQ ID NO: 928

SEQ ID NO: 932 - DNA, 201 bp, Homo sapiens; identical to SEQ ID NO: 929

SEQ ID NO: 933 - DNA, 201 bp, Homo sapiens
ggagaaagaaatgaattctcctaactgggagtgtttaattatgtataaagttcgttgacctcacaggcggctgtcagatgatcttgctaaggcctgtgaayggcatcccaggaatgcagtgatgtgggcagaaaccgagtgagttcatgccaccgaatgctttaaatgggaccgaatcagcagccgtccagaaagactcca

SEQ ID NO: 934 - DNA, 201 bp, Homo sapiens
ggcaccactctcttcctccccgtctacttggtgaacaggaattagaggagcaggcccccagtgtggaaggaaagggaagccagtgctgtggagtacccacygaatgccgcaccgcacacttgcacatacatcctctcacttcaactcagcaagaactctgcagggcgggtattttacagaccaggaagcccaagaccacac

SEQ ID NO: 935 - DNA, 201 bp, Homo sapiens
cagagcccctggagagctgtgggatggctaactgcgggagccctgctactccgggtaggggagaggcgggggcctgtgaaataggtgggcttggtgcttcytataacatttaaattacctgattgggggtccaatattatgttccttcagtagctttctcaccaaacacacattttatccatccaaatattatgctttcgg

SEQ ID NO: 936 - DNA, 201 bp, Homo sapiens
tgtgtgttctcttttgtctctacctggagcatccccatctgtctattgtgaaaggaccaggaaacgctgggagacgggctggcatgtgcttcttggtaacragagagcagagcccctggagagctgtgggatggctaactgcgggagccctgctactccgggtaggggagaggcgggggcctgtgaaataggtgggcttgg

SEQ ID NO: 937 - DNA, 201 bp, Homo sapiens
aatgtatgtccccagaggaggtgcaagcagggagatgaggttgtaaagttaatttagaacctgactaggagggttctaagtgctaggcaaagacaggagcstatcaacatattaacaatagggctgtggttttgtttgtttgtttgtttttggtggtgggttatgagtgatttttttttcttctgtttgcttttctctatt

SEQ ID NO: 938 - DNA, 201 bp, Homo sapiens
tggaatcttaaagttgagagtatggactcagggagatgctgttcattagccaggataagagatgtggtttgaaagagctggacttccttttctcactttgyaattgacctgctgactaaacttgggctactcacttcttaacctcagtctgtcttgaatttcccctgtgcaaaaaaacatgggaagacaatatctaaatgc

SEQ ID NO: 939 - DNA, 201 bp, Homo sapiens
ttagctcctacgttcattttatctgcagaatttctccgtggtgaactggatgctaataccattataagagcttcatagagagacagagaataagcacatcygagagagaaatcaggactttgcaccctggggatactgcctcaactgaatctgcatcagtaattcggtgggatattgtctcccccaaggcatccctgctat

SEQ ID NO: 940 - DNA, 201 bp, Homo sapiens
agcaaatcagtgaacctctctgggccttatctgtgtgctcatctgtaaaatggggatactcatagtagttatgacttagaggcagtggttaagcgcatggkctctggaattcgatctggacttgatcctcagctctgctacttaccagctgtgagaccttagtcaatttacttaaactctctaagatgtactatcctcatc

SEQ ID NO: 941 - DNA, 201 bp, Homo sapiens; identical to SEQ ID NO: 704

SEQ ID NO: 942 - DNA, 201 bp, Homo sapiens
cttttttcacaacagttgttaagttgttagcaaacctgtgttttcacagcaagctaggaagtcccttagatcattatccagaaaaacggcatgtaattagractacacagaaaggcgccctagaaaatacagaacagggctagaggtacacacctgcagacaggtgttctacaacaaggctaagtgcacatctgtccacct

SEQ ID NO: 943 - DNA, 201 bp, Homo sapiens
gagaggtggtcccatcaagaactacgtgacgctggtgagccgcctgaatgtttggcaggcccgtgtctccagtatgcctatcgagttgctcacaaaaggcrggttgctgctacttagctgccatgatgtacaggcagagatgggtgagtactgcttctcttccctctcctccttcccttttctgtatgtctattcacatgg

SEQ ID NO: 944 - DNA, 201 bp, Homo sapiens; identical to SEQ ID NO: 585

SEQ ID NO: 945 - DNA, 201 bp, Homo sapiens; identical to SEQ ID NO: 638

SEQ ID NO: 946 - DNA, 201 bp, Homo sapiens; identical to SEQ ID NO: 585

SEQ ID NO: 947 - DNA, 201 bp, Homo sapiens
ttttaattttgttacaagtggaaagaagtacagactgtgtgtaaaatatatttaataatcttcagttgattaaaagtgtctgacctcctgaataatccatytgaaacttgggttagggagactaaggcatatacattcagtgcaaaggtctccttaggaatagggctcagagtgagggtttttaaggtcctatctgctagg

SEQ ID NO: 948 - DNA, 201 bp, Homo sapiens
acgcaggtggctctcatgtccattgcagttcctctgtctcttcttatagcttatcatctgatccttgtacctgcgactgagccctaagaaatctccaagtyaaacattagccaggatcagatttgatagctgggctgtccactcaggatactgcaaaataaatactacacggaacaagcagaatactaaacaaaggacaaa

SEQ ID NO: 949 - DNA, 201 bp, Homo sapiens
ctgggacaaattgagttttctgtgcctttgggtttttttccacttaaatctcagacgctgtaatagcagttatattatctggtctcctcaggactactccrgagaggtacttttaggacaaatgggtatttgtcaagttgttatggatgttcacaataaagatatgatcatagttctgattaattgcttagggttaatata

SEQ ID NO: 950 - DNA, 201 bp, Homo sapiens
taccagaagactcttttccattctgtttttcatagagggtacccacagacatcaggaaaacaataaccaggaatactggaattctccatgagccagccagrgatgctgcaaattattaagaattaacatttttagtgaaataaaaacctagtacttgtttttacaaaactcagttttgtagtttgacagaacaatctggta

SEQ ID NO: 951 - DNA, 201 bp, Homo sapiens
atttcaggcaacaacagagtaaaattaatatatgctgggtatttacatttgttccaaagcaaacaaaaatgttccagactatttatctctagccatattaygttctttccttaaatctactcctgagtattcccagtaaatttcctttctcatgtttttgcttctattttctttgctctattcttaggtctctaagagagc

SEQ ID NO: 952 - DNA, 201 bp, Homo sapiens
cctccatcaaggataattaagtgagcacaatttagcatgtaattcagttaattatgcttttatatgacgacagcaacaatgagagcatccctgttactcayaggtcagacttttggcaacctcctaaaatatagtttttaacataggtgatgataaaaggcctcctgaggaaaatatctgtcacaaagcccaagatttcta

SEQ ID NO: 953 - DNA, 201 bp, Homo sapiens
gagaaagctcttcagaggaatctctgtaaaatctgtacattttaagtcttgaatttgagccagtaaagaaacagccctaggaacttaaactgcaaaaaaamcaccttgaattatagccttaaaattacataacttgatatagctttggttagaaaaatgtctcaggccataacccattctttagtctgtaccatatttatc

SEQ ID NO: 954 - DNA, 201 bp, Homo sapiens
tagattatagttctggtaccaaaggttgttaaaattttttctgtatttaaaataaggtgataataaaacaaatggtttttaaatgccagtatactatggarccaagacataagctactgttataatacataattagtgtatgcactcccaagaagggaagtcgaatctaatttgtaaaagactgatttcctcatatcgctg

SEQ ID NO: 955 - DNA, 201 bp, Homo sapiens
gcctatcactaactcccctactcactcaagagggatccctcagcagaaaccaatgccctacagtttagactggtctgccttcaccttcctgggtaaaggtkaatctctatcacctactacctaccaagagaacaaccctgattaaaaacaacttagtttagcctactgggtttctcccaagtaagcgaagggataagtgca

SEQ ID NO: 956 - DNA, 201 bp, Homo sapiens
tccctcagcagaaaccaatgccctacagtttagactggtctgccttcaccttcctgggtaaaggttaatctctatcacctactacctaccaagagaacaaycctgattaaaaacaacttagtttagcctactgggtttctcccaagtaagcgaagggataagtgcaactgagaaccatttcagtgccatctcctaatgagg

SEQ ID NO: 957 - DNA, 201 bp, Homo sapiens
atctgtagacagtgagattttgagtgatttttagtttcttccttttgtttctctgtatttcctaactttactgcaacacacatattatctgagaaattaaytctttttaaaacatactgcagctagtaatctgctcttggagtttattatcgccatcagaaagaagcaaggagtaaagtattggtcaactgtagaagcttt

SEQ ID NO: 958 - DNA, 201 bp, Homo sapiens
tcagagcatgaagaaaaaagaactgatgggattactaaaaaagacagaaaaaaactatctcctacgttattttggtcaaatctatcaatacaaataatctycgcatcttaaaaatgtttatagcttctaacctcagaattcaactttcagactttatccttactaaataatgataaattttgaaaaagttttaaatataaa

SEQ ID NO: 959 - DNA, 201 bp, Homo sapiens
  misc_feature (101)..(101): n is a, c, g, or t
cgtccccagcaaagcttcccgtcctctcgataggtgactcgtcctaaatcagctctgaattcccgcaaagacttctggaagctgtgctggggttgaaactngtagaccaaaaccagaatcaagtctgttgggaggggcctttcccctgggacgggaattccagtggtaatgtcttcctggggcttctccggaaggtccaat

SEQ ID NO: 960 - DNA, 201 bp, Homo sapiens
ttcctgtccttttggtctgtgccatccagctgcaactaacctcccatacaatgtcgtgccatgtcaacgatttaccagttagtgaaatgtttcagtgaaargcttatcaaatcaattcaaccaaccttgatgaaactgacgtgcctgggagagggccagatgaataaaatgaagtgtagagatacataattttttttaagt

SEQ ID NO: 961 - DNA, 201 bp, Homo sapiens
tcctttttcccattctccttttaaaatgtattatatccaaagagccagaggacagaagacctcacttcttacttcaaagatgtatggcccctaatttcccrccttccccgctccactgaactcacagtatttatatccatatccattctgacctgctttccccagctgttccattcgtgccatggattcatctcatgcttc

SEQ ID NO: 962 - DNA, 201 bp, Homo sapiens
caaagaaaataccaaggatctgctcaacaactaaacagagaggacagagcaaaaagaaaacaacagagcttcaggttttaaacctgaaggggaaagaatascagtgtctcaaagtcatggagaaggccagaatggaagaggcatgcaagaaaagggcagtttgtttagtatgggcaacaggaactcaaaaaggatgatgaa

SEQ ID NO: 963 - DNA, 201 bp, Homo sapiens
cacaaaatcataaaaacctggactctatggggtggtgcagaggggtgcagggaaagcaccttcatatggtcactacagaagaaaagctgtagttgaaaaasaagacgttagcggcaaacgtgaccttgtacatgcaaaaagaaacaccaagcttttctaaagcatcccaagaggtatactgttaggagcaaagtgaagccc

SEQ ID NO: 964 - DNA, 201 bp, Homo sapiens
gttttataaataaaacagcagagaaaaatcctcttacaatttaccagaaaacagaatttaactccctcaaattcctagcaactttttcttcttttttatawcagctttattaaactatgatttacaaataataaaactcaccaatttgaagcattcaattcagtaatgtgcacaaatatatacattctataaccatcatta

SEQ ID NO: 965 - DNA, 201 bp, Homo sapiens
caaataatcctacattttaaacaacttgtgttttcagaatatatacttgatagattgctagaattcctttcatgcaaagctaccatctaacatttcaaaamtacatttaactagattaataactgctgaaacaccacaatgcactgctcaaccccaaggtgagcaacagcattgctaaataagttattcttaatttagatc

SEQ ID NO: 966 - DNA, 201 bp, Homo sapiens; identical to SEQ ID NO: 948

SEQ ID NO: 967 - DNA, 201 bp, Homo sapiens
tcttagcccattgcttccttagctctattccctacgatatactcacactaaggctgaggccaaccagtggaataaacaaccagccttctgctgcaaacctragcaagactgaaaaacaggagatggttgatgcatttcaaattgcccagactaggccaggcgcagtggctcatgcctgtaatcccagcactgggaggctga

SEQ ID NO: 968 - DNA, 201 bp, Homo sapiens
ctgttctatacatgacctatctaccaactagaatataagcccctcaaaaaacagcaacaaataagcacacaataaatccttgcttaaaatgcttaaaatayccttgtggatgagatggtgaaacatgagttgggtaataatacagcattctcagaaaatgagacttgtggacatatgagttttctggagaactgctgtttt

SEQ ID NO: 969 - DNA, 201 bp, Homo sapiens
gtagaaagggttcagctaagaactacagtccactctcagccctgtcatgtactataggacaagtcttcattcacaacaaatggatagcaacaccaatctcrtaacactgggaaaactgcatacaatatttagaaggaacactaatacagcagaatctgcacacaacggagtcaaagatctgaggccaaatcctactacact

SEQ ID NO: 970 - DNA, 201 bp, Homo sapiens
ccttctcctactccctgtctttctggcattttgtagcttgttagattttctgccagaggggtgggtcagagcagtggaggggagacatcgcccatgtgctkctgctactggtccttgggctgggtggttggtagaggagatgttgacactatgagctaagggttggcttttgtaattacctgaatctgaaaggaatgccta

SEQ ID NO: 971 - DNA, 201 bp, Homo sapiens
tagatctgaaatgaatgaagggacagaggatgctgcaccaccttgcagaggaatcaacgagctcttaaaaggcagcaactagcaactgctatcaatgacakgtctctaacaattatttactggagagttttataagcaaaccacaagtccattggacagaagataaagcttacacactcagttaactccttcactcctaaa

SEQ ID NO: 972 - DNA, 201 bp, Homo sapiens; identical to SEQ ID NO: 735

SEQ ID NO: 973 - DNA, 201 bp, Homo sapiens; identical to SEQ ID NO: 727

SEQ ID NO: 974 - DNA, 201 bp, Homo sapiens
tgagccgggcatcagtggcggcgtgttggggaagcgtggtgctctgaggagggcggctgcaggaggagggtggctgcagaagcacggacgtgtggttgtcrtcgtcgttactgaaacaacccctcatcacacggatgacttatgggactgcggccttcctgaagcagggacggttgcccttggttctccacagacaagtct

SEQ ID NO: 975 - DNA, 201 bp, Homo sapiens
tgagcactttactgtaaattgaagactttgcaaacttaggaagataacacagtaggcttaaagttcagaagataaatttatagatcaagaaacccagagcrgaggtgatcccaagaaacctctgcctgatttgttgattttcacagtggtgcttcctgaagtgtagaagggatgtttgcagatagcttggttttactatct

SEQ ID NO: 976 - DNA, 201 bp, Homo sapiens
gacagataccttcttaaatcagttcacagggactttgggccgggctgcttgtgtgtgctcttgctgggtgctgtcactgcacacagcatgattgtcccctrcctacacatgggtacccttagggtttagcgtttgcttctgtctccctgggtgatagcgtgaatgccaggctacggtgccctctgggaggcagcaccagca

SEQ ID NO: 977 - DNA, 201 bp, Homo sapiens
gcgtggaggctggaatgagagcgttcagggcttttcacccctgttttctgtcagcatctgcaaagacgaagtgtagaaatgtctcgtattaagaaaagacrttgctctctgctccctgtctgcacgcgggtttcccagcctttgcacacacagacattctgagccagatggcctggctgggagcatcctgcatgctgtggg

SEQ ID NO: 978 - DNA, 201 bp, Homo sapiens; identical to SEQ ID NO: 728

SEQ ID NO: 979 - DNA, 201 bp, Homo sapiens
aattaaaaacacacctggtgaaaattctaagacaaaacgggatccttctaactcagagtcgctagagttaccaccacaatcaaatgcaccctagaagcttytggcggtgtgtgcgcgtgggctcagggctcgtgaccctctgttccggcccacgcttctgaccggtgattagaaagcggcacgttctatcctcggccctgt

SEQ ID NO: 980 - DNA, 201 bp, Homo sapiens
acccaggtggcgtggccagtgctgtttattgcagccattctgataggtgtgtcctgagctggttgtggctgtaacctgcatttccgtggtgaataattacscatcactcctgtgtttgttccatctgctagtccttggttggatgtgtggcttacaaatcctttcctcccagtcagcaacttgagttttcatcctctagag

SEQ ID NO: 981 - DNA, 201 bp, Homo sapiens; identical to SEQ ID NO: 729

SEQ ID NO: 982 - DNA, 201 bp, Homo sapiens; identical to SEQ ID NO: 730

SEQ ID NO: 983 - DNA, 201 bp, Homo sapiens
cttagcccatggttgggtgaggtccccgtgtggttgatctgtccctgagtccccgaggtccccttgcggttgatctgtccctgagcccgtggttgggtgargtccccgtgcggttgatctgtccctgagtccctgaggtcccccgtgtggttgatctgtccctgagcctgtggttgggtgaggtcccccgtgcggttgatc

SEQ ID NO: 984 - DNA, 201 bp, Homo sapiens
tttttcttcttttgcctgtcagtatgtggtggtcacattgactgatttttggacatgaaaacaaccttgcaccccagaaacaattcccgttggttgtggtrtatagtaaccttgatgcgcttctgtgaagtgtctttatgttgacgttgaggggcctgtggggctgcacttgtcacgttgtgtgccgtctgcccccaggtt

SEQ ID NO: 985 - DNA, 201 bp, Homo sapiens
cggttaatggggagatggagaggtacggcttgatgtccttttcgagcctttgcaggatccagcactgtccctgcgtggggatgctgaggcctggagtgcayggccctcccaagtcaggagcaggggtggccagggcgtggccttcgcacagtgggtggcagctcccgaacctgggtggacaggtgagaaggccccgccagg

SEQ ID NO: 986 - DNA, 201 bp, Homo sapiens
tcccagttttccttaaacacatccctgggtattgggccatagtgttctgtagagagagtgaatgtgggggcggtggctctgcggggaataaccgttccccrtgcgcagtggtcaggctgggcgctggctggggccccagagagcagcgtggtttaacttgtcagtcaggcatgcagctgacgtccaccctacgaaagttaa

SEQ ID NO: 987 - DNA, 201 bp, Homo sapiens
cctgttttacttatgcaagtgccttccataattttcatatccatctggtttagataggcacttcagtaagatattacaaatttttcatgttagtagaattrtaaacacttatcaacatggtttgtgtttgagaaataagttcaccataagagaaaagaagccccacacgagccacgtcttacctcaaaagggatgaagtgt

SEQ ID NO: 988 - DNA, 201 bp, Homo sapiens
agcctcttgggagagtaataattatgttgtattcattcccgcaccttatattcctagcaaaattccaagtaatgttaaactcagtaaatgttaaatgatcraatacccttaaacacgttatgtgggtgccatggaatacctatctcttgaggtatgtgcagatttatggcttcagccacttgtatgatgagtagctgaaac

SEQ ID NO: 989 - DNA, 201 bp, Homo sapiens
cacaagccccagtgaggaggagcatgtggaaggctcggatctgtttaaatgcttggctggaggggtttgggctaaaagcagagggtcccaggttttagccrggctacacccttgccacccgtcacaccagcaggcagggtatgggtcaccacagtctgattccacgttcatgaggcctcgtgtggtgagagatgaagcagg

SEQ ID NO: 990 - DNA, 201 bp, Homo sapiens
tgcctgctatgatctgagggttttacagcccccaagtccatgtgttaaaacccagtcccagggcgagggtgttaggaggggcgtgggaggtggtgaggtcmtgtggactccatcctcgtgaatggaatcagggcccttacccaggtgggccctgggagctgcgggaaatgcagcaagccggcgcccactgacctgcagcca

SEQ ID NO: 991 - DNA, 201 bp, Homo sapiens; identical to SEQ ID NO: 731

SEQ ID NO: 992 - DNA, 201 bp, Homo sapiens; identical to SEQ ID NO: 732

SEQ ID NO: 993 - DNA, 201 bp, Homo sapiens
agccggaaaacggcagtttttaaaaagctatcgtgtgcaatagcaacagaaaataaagtaaccaggaataaatacaaaacaaaaatgagcaagtgctatayggagaaaatcataaaaccttattggaggactttgaaatggacctaagcaagtgaaatggtagaccaagttgacagatgggaaaattcaaatcacaaaact

SEQ ID NO: 994 - DNA, 201 bp, Homo sapiens
taaactacccacagcaatgcaagaaaagaaagaaaagctacaaaacttggaagggaagcataaaacaatcatcattcataaatgatatgtgtttttaccayggaaactgcaaataatctaccgatatactattagaaataaaagatcttagtaaggtgagtgcgtggcgccagttcatgaaaatccactgcagttctgtaa

SEQ ID NO: 995 - DNA, 201 bp, Homo sapiens
aaagataaagaaatttcctatacatttggaaattttaagatgtactttgaactaactccttcatcaaagaaaaagattgcgatagaaataaagccatactygaatgattgactattttgaaacttgtgagaggaagcaaaagtgagatctagtagggcatttatagctctgagatttgattcaaatgaacacaggcttaaa

SEQ ID NO: 996 - DNA, 201 bp, Homo sapiens
gtccttacaggtggaggatccctcctcccccaaatccaaagctttttgagtgcccacatggtgcttaaaggaaatactcattagggtattttggatttttyggattggggatgttcagctggtaagtttaacgcaaatactccaaactcagaaaaaaattcaatatccaaaacgtccctggtcccacgcacttcaggtaag

SEQ ID NO: 997 - DNA, 201 bp, Homo sapiens
ccccatttccacccggaagtccgtccttgctgatgtaacaccatgtcaggtgtggcttgttttcccgaggagcctggtggccacagcctcagcttcagccrcttcctggttctcggtggccagtccccacagactgtgagacctatgcttgctaatgttaactaagaagagaatctgaaagtatttacttcagaaacctcc

SEQ ID NO: 998 - DNA, 201 bp, Homo sapiens; identical to SEQ ID NO: 733

SEQ ID NO: 999 - DNA, 201 bp, Homo sapiens
ctttctccgcgtcacatcagcagggcccctccactcacggggactttccacattttgctctttttctctgcctcatgtatcgaaataaaagcaaccgcaarcacatgcctcttctggaatgcgtgctctgtctcaaaacccagcccaaaaggaagaagaggaggaagaggaggaggagggggaggaagaaactggttttcc

SEQ ID NO: 1000 - DNA, 201 bp, Homo sapiens
gctgcggcccaggtgaggtggaggaaggccctgctcatgttgccctcaccactacctgctgagggagcgagtttctgggagtgatatcttgagcctcttcygcttgatctcctgggagggctcatccgttcaggtccacaggacattttaaagagctccctgtgcgatcgtgaggtatattgaagtttaagaaccactact

SEQ ID NO: 1001 - DNA, 201 bp, Homo sapiens; identical to SEQ ID NO: 734

SEQ ID NO: 1002 - DNA, 201 bp, Homo sapiens
gtggagcagagcctgcactagaataagacagtcagaacctttcaaccgcagtacagaaaattacgtgactccgacgtggccagtatgcgagtgattttctrcgaaggcctgtgtttggtcacgttgctggaagcctgcggagtgctgcctgcgtgcactgggcgcaggtgcccttggcgtcaggagccggccttgtctctg

SEQ ID NO: 1003 - DNA, 201 bp, Homo sapiens
cggctggtaaacagcactgtgaggaagggaaacttgattggactggaaggcgttggtagccgggatctgtgctgccctggagtggggagattgcaggcccygagggatgcttcctgagcatgtggcctctgtgcctgtttgcccgcgtggacccgagatcagccctcagcctaaggttgtggcccctggagaccccatgta

SEQ ID NO: 1004 - DNA, 201 bp, Homo sapiens
ccatggggcatcccgcctggaaaggtcccattgacagatgcagcttgggtggctgtctcatgtccgcgggtcagggtggtcggagcagcccggctgggacrggagtgtgggggctgtgagcacctaggggcgggtgctgagtgctgggcggcctcatgtctgcagggcagggtggtcggagcagcccggctgggatgggag

SEQ ID NO: 1005 - DNA, 201 bp, Homo sapiens
tgcagttggtgggccgcctacctgcatctcattcttcacgccctccaccattctgtgtgtgacaccagcagcttccaaactcagcagcccctggtgatggmcacttggttgtctccatgctgatccatgtcatcttacatgtgtgcaggcgtgtgaggtgtgtgcaggtgtggggggggatctgtacatctgcgcaggcgt

SEQ ID NO: 1006 - DNA, 201 bp, Homo sapiens; identical to SEQ ID NO: 959
  misc_feature (101)..(101): n is a, c, g, or t

SEQ ID NO: 1007 - DNA, 201 bp, Homo sapiens; identical to SEQ ID NO: 968

SEQ ID NO: 1008 - DNA, 201 bp, Homo sapiens; identical to SEQ ID NO: 969

SEQ ID NO: 1009 - DNA, 201 bp, Homo sapiens
tggaacggtggtagaaacaagtaccaattctgaaccaactgttgaagccttagatttggtattaaatgcaagatgttcattttttccttgcttttgcatayagataggtgaattcaaggtaggagactgcaactgccccacagaagtagaggacttagtattaaaaagaggtaaggaacttttgacattgtgaagacttgc

SEQ ID NO: 1010 - DNA, 201 bp, Homo sapiens; identical to SEQ ID NO: 585

SEQ ID NO: 1011 - DNA, 201 bp, Homo sapiens; identical to SEQ ID NO: 633

SEQ ID NO: 1012 - DNA, 201 bp, Homo sapiens; identical to SEQ ID NO: 1009

SEQ ID NO: 1013 - DNA, 201 bp, Homo sapiens
gggccacccgcctgcgctccgccgacgcccttggaacaatcggctggagccctgaaacccgacgtggaccttctgctccgagaaatgcagctgctcaaagrccttctgagccgggtggtcctggaattaaaggagccacaggccctccgggagctcaggggaacgcccgagacccccacctctcactttgctgtgagcccg

SEQ ID NO: 1014 - DNA, 201 bp, Homo sapiens; identical to SEQ ID NO: 785

SEQ ID NO: 1015 - DNA, 201 bp, Homo sapiens; identical to SEQ ID NO: 589

SEQ ID NO: 1016 - DNA, 201 bp, Homo sapiens; identical to SEQ ID NO: 592

SEQ ID NO: 1017 - DNA, 201 bp, Homo sapiens; identical to SEQ ID NO: 593

SEQ ID NO: 1018 - DNA, 201 bp, Homo sapiens; identical to SEQ ID NO: 244

SEQ ID NO: 1019 - DNA, 201 bp, Homo sapiens; identical to SEQ ID NO: 609

SEQ ID NO: 1020 - DNA, 201 bp, Homo sapiens; identical to SEQ ID NO: 610

SEQ ID NO: 1021 - DNA, 201 bp, Homo sapiens; identical to SEQ ID NO: 612

SEQ ID NO: 1022 - DNA, 201 bp, Homo sapiens; identical to SEQ ID NO: 615

SEQ ID NO: 1023 - DNA, 201 bp, Homo sapiens; identical to SEQ ID NO: 632

SEQ ID NO: 1024 - DNA, 201 bp, Homo sapiens
acccccccagggctgagctggccctgcgggtggctcctttaagttcttcagcatgcccaccttccccgtggacagctccaggaacagcaggtccggctccrtgtgcagagccgcgtagatgttgtattgattgctttcagtgaaggagcgctggaaggccaagtctgagatgcccgagtttatttgcaggtcatacagggt

SEQ ID NO: 1025 - DNA, 201 bp, Homo sapiens
tcattcaaaccaggacacatgtaagttccactcatatgtgggagagggaaggcgagcctgtttttgctgagtctctgatctaggcggtctccagagggctmtgtgggttgtacttcttcgatgcccatgtgagagtcaccacagcctgagacacataaggagaatgcagtagtgccagcctgtggccttctgttctgggtt

SEQ ID NO: 1026 - DNA, 201 bp, Homo sapiens
tcctgacctcaggtgatcccccaaccttggcctcccaaagtggtgggattacaggagtgagccactgtgcccggcctcaacaaatgtattgatcagcaaayatgtgtcagtcatggtctaaaaaactggggccctggagcagaataagtcaccatctctgccctttcaagaagcctgtggtttagtggaatgaatcccact

SEQ ID NO: 1027 - DNA, 201 bp, Homo sapiens
gatctagaaagcagataccctgtttttctctccttgagcctccctgaccccaggacagggctgtccccatgtagtgaggctgtgtctcccacaccacctgyggtgctctggccggggcatccagcatatccaacagccaaagactaattaattccctttggcattgctgtgctgccaataaaacctcaacgttatgactgg

SEQ ID NO: 1028 - DNA, 201 bp, Homo sapiens
ggacagactcgggcgcccggcccaaagcccggcaggggcgtgtccgcgcgctcacctgctattggccaggtggggctgtcggctgccagcagtgcttatgytttaagtgcggagcgggtggctgcggagccaggcgcggcgcaggatggtggacagcgtgtaccggacccgctccctgggggtggcggccgaagggctccc

SEQ ID NO: 1029 - DNA, 201 bp, Homo sapiens
ctgaatcccaaacaccaggaagagaagtttgtatccatgtgaaaagcaaacatgaactgctatattattcttttcataaaggcagtgaacccataaaatcrgggttttcagatttatgtgagacctgtgtgccagacagactgagatggactttacatagacagagcaggagtccgattattggagtctgtgtgagggaat

SEQ ID NO: 1030 - DNA, 201 bp, Homo sapiens
gcaaagagggctgtacgctaggtaattattattgtagcttatggtttgcttggcttgtgggaaacattttgtaaaaaatcaagtattttactggattactraagacactaaataggtgttaaaggtatttttattttttttgaaaattccaatttctttctcctccaaacgagaacagggtttatagaaaaaatataatgg

SEQ ID NO: 1031 - DNA, 201 bp, Homo sapiens
aatgcatttttcacaaaccaaacctgaagtactttatcctattggatcatggcaaaaaccccaaataaactgctgaagtacacagacgagctgctcttctsttatcagcctgactgcgtaccagctctgtgtgaggcgtctggtgaattcccgacccacaaatagtctcatagtctcatttttttttttttttttttgaga

SEQ ID NO: 1032 - DNA, 201 bp, Homo sapiens
cgtcatcttgcattccccagtggttagcaccgtgagagcactgaggagaggtacagatgacaccacagcacagtgaagccatggtacagggcaacgagcastccaactttgaggcttggctcacactgatttgctgttataatgttggggaagcgaatgaacttaattgaacttcagggtttttcatcagtaaagctggaa

SEQ ID NO: 1033 - DNA, 201 bp, Homo sapiens
gataatctactatgaaataaagtagcaccatgccagacttgactgcaagtaccaaagcatgtcaaagctggtgggaagtatgcacagtcactgcttttctrtaactatcagtagctcattagtgtatttgtgcataatcttgtctcaaggctgagagacaatatcctctctcttcaagcttaaggccctgtgataaattaa

SEQ ID NO: 1034 - DNA, 201 bp, Homo sapiens
ccttgtccaaagatgaaacgaacttgcaggactttgtacctttgaatatgcttttccttctgcctagaacattctttctttcatgcttcctttaaccaccwcctccttcctcaattccctcccttccctcacctctcacaaagagaatctatagcttcatatgcagcttccacactactttgaactgtaaggaatcctgat

SEQ ID NO: 1035 - DNA, 201 bp, Homo sapiens
acctgcgagggcaaagtggttcaacagttcaagtcttgaagtccaatgtctaacagccctctcctctgacatgcgacgtacacccctaatgcaacacatcygaaactgagctctgggtctccttccaaaagacacttgcttctgccactgaagctctgagtgtggttaattccatcacttctatcttcaccagaaaggtcc

SEQ ID NO: 1036 - DNA, 201 bp, Homo sapiens
agaaaattacttctggcacttaaacaaaaccactctttcattcatttttattcactcatacttatttattcactcagtttcttgataaatacttcctgcgkatatggagagatgaacaagatgaagtccctgcttttaagtgtttagaaaactgaggcgttgctgacatgctgactgatgacttgccatcacataagacac

SEQ ID NO: 1037 - DNA, 201 bp, Homo sapiens; identical to SEQ ID NO: 557

SEQ ID NO: 1038 - DNA, 201 bp, Homo sapiens
aaagcgagactctgtctcaaaaagattaaaaaaaaaaaatcaaaaccaagttctctgaaatgatagttatattacaaagaaaaatcatgtaaataattgaragagagagacagtgccttatagctacagattatatgaatttgataatttctgcttactatgtctctaaccaagctgtaagatgctacagttctggcaaaa

SEQ ID NO: 1039 - DNA, 201 bp, Homo sapiens
cacaaaacattaaagctaaaatgaggctcttagaaatatagtctcatagtttgtaaacattttttaaacaatgaaacctttcccagaaaacaagtccacaygaaatagataagaggggctactcccaacccacaaggcagctgggagtaactcagtttgggaaccactgaggatcacaatttgtgctgcacctaggagcag

SEQ ID NO: 1040 - DNA, 201 bp, Homo sapiens
tcaagtgaatataatgaataatgctctataaatttaatgctttataaattgaaaggtagtaagtaaatgtaacaaattgctattatcaacaagtcaaaatrtaactatgtgagggagagggaagagctgctgaggagagaaaatacttatttcttttgcaactctttagtaattctgtgacctatcacaatctgctgctga

SEQ ID NO: 1041 - DNA, 201 bp, Homo sapiens; identical to SEQ ID NO: 560

SEQ ID NO: 1042 - DNA, 201 bp, Homo sapiens
tgatgatgctggcgctgccaccgcggggtgactcacatgagtcctgtggtgccagtccagagccaggagcccctggcacttaggaaagggccgagctgatrgcagcgtctgccagcttgtcagttctgcggaaacccttcacagagatgggtctgggcttggacttcaaaggctcctctggtaaagacctgctaattgctt

SEQ ID NO: 1043 - DNA, 201 bp, Homo sapiens
gtcgtggaaaccaattaccgactgtatgcctacacgggtgaggcgggacagagggcccctggaagaggaggttgggggtgagggaatgccagtttatgttygtgtttacctggcagtctacagagctctctgacatttctcatgacacttgaaagaagggcttgagggagtctgggtgtgggggtggcctcctcatcctct

SEQ ID NO: 1044 - DNA, 201 bp, Homo sapiens; identical to SEQ ID NO: 179

SEQ ID NO: 1045 - DNA, 201 bp, Homo sapiens
atggagagacaagaggagaagctggtttggaaagctgtctcatggtctgggaaagggaaaataatgttttggacaaaggtggtaacagtgaaggtgaagakaattcttttgcatagatgggacttaaatgcaaaaagtcaagggaacaacagaagtagggaagttattcttgccattttgaacaaattcatttggattctg

SEQ ID NO: 1046 - DNA, 201 bp, Homo sapiens
gttagagtttagcctgagcaacatttgaggccagccagggaaacatatcaagaccacatctcaaaaataacaacaaaaaaaaatccaggtttgcttgtggkgatcacctgagtccatgaaataagtagacattggggctgtagcaatgcagagataggtggaatcaagacatagtcctcttgcattccacacatcacaggc

SEQ ID NO: 1047 - DNA, 201 bp, Homo sapiens; identical to SEQ ID NO: 589

SEQ ID NO: 1048 - DNA, 201 bp, Homo sapiens; identical to SEQ ID NO: 592

SEQ ID NO: 1049 - DNA, 201 bp, Homo sapiens; identical to SEQ ID NO: 615

SEQ ID NO: 1050 - DNA, 201 bp, Homo sapiens; identical to SEQ ID NO: 618

SEQ ID NO: 1051 - DNA, 201 bp, Homo sapiens
ttcacacatctattcattcggcaggcagtgagcactgactctgtgcctgccactatactaggaagtcaaagttgatattccagttagggataaagaaaggmctgctgggtgcagtggctgacgcctgtaataccagcagtttgggaggctgaatcacctgaggtcagaagttcgagatcagcctggccagcacggtgaaac

SEQ ID NO: 1052 - DNA, 201 bp, Homo sapiens
gcttctttgtagcttttggtgaaggccctagagtatctgcttatgtcctgacaacatggggattctctgggacaaggcaagaggacccaagctgtgttcaratgagacccagagatcccagtgcaaagggacacctttggtaaaactggccactttgggtcatatagatcccaaaagaaatcatgcctgacttcctaaaat

SEQ ID NO: 1053 - DNA, 201 bp, Homo sapiens
cgatttttggcggtgtcaaagaaattcattatttcccttgaagcttattttaagcccataacagtgctatctggaggatgaaggcttaggtagaatgacartctttaaaattactgggccaactattgttgttctagaacttgaccatccttctttctgaatatctcttaggagctttcacttcagcctgactcaggagaa

SEQ ID NO: 1054 - DNA, 201 bp, Homo sapiens
attttggtttcctgactgttattccatggctattgacatcataactgcccgtttttacaaaatgctttttcaaagggcatttttacagcttattaaagatytgatacattttaaaagtagaaaaaaaaaatcacatatggagtcatcatctcagtacagccactgcagtctctcaggggaagtcttactccttttctccag

SEQ ID NO: 1055 - DNA, 201 bp, Homo sapiens; identical to SEQ ID NO: 943

SEQ ID NO: 1056 - DNA, 201 bp, Homo sapiens
cagccccccaggtgtgttccagcaagctctattccactagggaagaaatgagtcatcgtatgtgttgatacaggctgaaggccgccacaaacacatacctkcaggagcttctaatctcatcaggaacatgttgagagtctgacggcctgttataacggcgaaccaccctgttccaagcagcgggacttgctctgctttctc

SEQ ID NO: 1057 - DNA, 201 bp, Homo sapiens
ttgacaatcttttaataatttccaaaacaatcgggggtaatgttcgaattctaagttcttgtcataaatgaatcaatccagttggcaggagatggatgtastctttttgctggtgttccgtgctaagaaaagcacacacatttttcttgagagtatggctagccgaaaagcatctgagaattgatggaatcctaaggcaga

SEQ ID NO: 1058 - DNA, 201 bp, Homo sapiens
acaaatgtatgtatatttataggatgcttaggcaaaatgaagccctgagctgtaaaatgtttcatgacagtctttgctgacagagaacgctgtaaatgggwgtcaggtccccacttagacagtgtaacagaaatccatgccagggtgaaataagagctggcagttaggatgatagactttgaaatcagccatcacagtata

SEQ ID NO: 1059 - DNA, 201 bp, Homo sapiens
agtggttattatcaaatttttattttagaattgtagattattattattattattatttgaaatttgacagactttcctttgttcagatccaagctgtgccrcttattacatgtgtaacatttatcaaacattttagccttctcaaactttaatttcttcttttgtaaaatgagaatcacaatgtctacttaataatcttat

SEQ ID NO: 1060 - DNA, 201 bp, Homo sapiens
tctgtaacttagcaaaaatacaaattggtgtttccactttgatttctctttttgaaataaattttcagcttgactttcttttgcctcgggtattctggatkatcattttgtagcatctggataattttacattaacatctggagttgagggtctttttatttgtcggatgcatatagaatacttctgtaagaaatgtattt

SEQ ID NO: 1061 - DNA, 201 bp, Homo sapiens
tatatgagatccattttcattcttaaagaaaattattatatctttttattaatatggtggatatttactcagtaaataataaagaaaactaatatgaagtrcaatttgtaatattctatttatgatgcatgatttttgttgcacaattagaaaatacttaagttcttgagaatagttggaaagggttgtaatgatcagaaa

SEQ ID NO: 1062 - DNA, 201 bp, Homo sapiens
attcttaaagaaaattattatatctttttattaatatggtggatatttactcagtaaataataaagaaaactaatatgaagtgcaatttgtaatattctayttatgatgcatgatttttgttgcacaattagaaaatacttaagttcttgagaatagttggaaagggttgtaatgatcagaaacacatattatacctaaac

SEQ ID NO: 1063 - DNA, 201 bp, Homo sapiens
aaaatccagatcatactgatttgttgccatggtatagtagtcagagaatcttgctctgggcagttacaatattttggagattgttttacataatagcaacwataacaggaacaatgataactgctaacttgtttacatttacaaaatgtcaaatactattctagattattcaattgaatcatcacaacaacgctatgaggt

SEQ ID NO: 1064 - DNA, 201 bp, Homo sapiens
aacaacgctatgaggtagttactgttatattgttttgatttccctgatggagacttgacacaaagagagactaagtaattcactcctgtcacacacagctwaaaagtggcagagctgagtgttttgccccaggtagtccagttctagaactgtactcttttccactatgctataccatcttcctaatactatctgtacaag

SEQ ID NO: 1065 - DNA, 201 bp, Homo sapiens
atctctggtggtctgttccagaactatgtccttgactctgtcacattcatacttttcatcactactttttatacttctgcaatttaggtcacccaatacasgttatcttatcaggttaaactgattgtagtggtcacattgaaaaagaaaaaaaaaatcccaaattcaggacttttcccaaccagttctaattaatgcacg

SEQ ID NO: 1066 - DNA, 201 bp, Homo sapiens
ttaaactgattgtagtggtcacattgaaaaagaaaaaaaaaatcccaaattcaggacttttcccaaccagttctaattaatgcacgtgtgaaaggacatarttattgtgaaaagaaatgctatcaaaacagtctaatggctacaagaagaaaaagaaaagaagaagaagaaggaggaggaagaggagaaggagatgaagaa

SEQ ID NO: 1067 - DNA, 201 bp, Homo sapiens
ctggtttttccccctgaaggtagaattaaaacaggtactcatgggaaacagctacttgtgttcttcttttcttaatggggtgaagctgaagaacaggaaaktgaatggcttagcctagaaccatctccaggaatggaggtaaattttttcctgcagtgccttctcaatttgatatctgaatctccctgaagagaatttgcc

SEQ ID NO: 1068 - DNA, 201 bp, Homo sapiens
gaaggtagaattaaaacaggtactcatgggaaacagctacttgtgttcttcttttcttaatggggtgaagctgaagaacaggaaagtgaatggcttagccyagaaccatctccaggaatggaggtaaattttttcctgcagtgccttctcaatttgatatctgaatctccctgaagagaatttgccttagtagatatggag

SEQ ID NO: 1069 - DNA, 201 bp, Homo sapiens
ttcccaatgtctttcttagatgattaggtagttgaaagacgctactgtttacgaggcattgctaaaagcttttgggttccatgagggagagggccatgacmtactcctttgtacatttccccactcctccgtttacatcacataaacatatatgtatggtcttccatgcagtcagccaaatcagacaaatcatgcctagga

SEQ ID NO: 1070 - DNA, 201 bp, Homo sapiens
ctgtgtaatcttaggtaactctttgaagtttagtttccgcatctaagaatgaggaagtataaatacatatctgcccacgttggttgtattaaatgagatamtttacataacacatccgactaaggtgcagatgtaataaatgacagctgttattatcatttatttcagcacgttgcagaaagcaacttacaatttcttctt

SEQ ID NO: 1071 - DNA, 201 bp, Homo sapiens
ttattctgaaaacagtaattttcaatatactattttcttataaccactttaaagaaattaaggacttgcaggttgtctggttttttactatttttcttatscatagcaaggttggtgctcaataatactagatgagcaactgaatgaagagatgacaaaaataaatgaatttattaccactgcatgttaaagaagtgtact

SEQ ID NO: 1072 - DNA, 201 bp, Homo sapiens
aattaaggacttgcaggttgtctggttttttactatttttcttatccatagcaaggttggtgctcaataatactagatgagcaactgaatgaagagatgayaaaaataaatgaatttattaccactgcatgttaaagaagtgtacttttttatgcttgtctttgagaaaagtgtcaaggtggcatacatgacaaaacacaa

SEQ ID NO: 1073 - DNA, 201 bp, Homo sapiens
gtccctgctgagcaaaagacaaagacctccttctccattgtcccgcactgatggtgggcttgggatgtattttcagaaataattatttgcagggaacttayaaaaacaaatgaatcaccctcatcactgtgcttgttccgttttgggatgtttgtctactagactttctaaattgggagatttagaaattcagtaagaaag

SEQ ID NO: 1074 - DNA, 201 bp, Homo sapiens
agtagtaaattataaacaatatattttgaattcataattaaaattaacgagtcaattttctgaggcattgacctattaaagatttatgagttacctaaaaycccaaatcttccctgaggtaatagcttcagttgagataaagggaaggtatcttatttgtcgcttcactgcaggaaaaaataaaatttgtgattatgactc

SEQ ID NO: 1075 - DNA, 201 bp, Homo sapiens
tattgaaggaaataaacttttttctaaccatatttatgcaatcaatatttattaggtagtttttgagaaaatcttatatgagaacttattccttgtatacmaaatgtttcatggaacaccaccagcatagacatttttgtttactctgtgcaactggatttcgttctggggagcttcaatttgtacatgagctcattttca

SEQ ID NO: 1076 - DNA, 201 bp, Homo sapiens
gaacaaaaaggacgaggcaataccttcttaacactgataattaaataagataagcttaaattataaaatcagcacagagggaatgtaaattggttcaaccrttatggaaggaaaaaagtaggaaggttcctcaaaaaattcaaaatgggactgcgaggccgggtgtggtggctcaagcctgtaatctcagcactttgggag

SEQ ID NO: 1077 - DNA, 201 bp, Homo sapiens
atttgaattacccgtgcattactgtttcatatattcatggtactttcatattttataacatttaaaaatatttcaatattccattgatttgaataagattytttaaattacagtgaaagctttctgataaggtatggtaagattatttttcagtaattatgctgatacatataataaagctactgacaattcataaagatg

SEQ ID NO: 1078 - DNA, 201 bp, Homo sapiens
ttaacaattttggtttggttcaatttgttgcataggtaataataatccatttacagaatacaaaaatagtgtaagtatgtgcttcttcctatctgtatgtygagagattcctcattcttttttatggttgcagataattcattatgcagatatacaatttatttaaccagtcccatattgatggatattaggttatttcca

SEQ ID NO: 1079 - DNA, 201 bp, Homo sapiens
tttacagaatacaaaaatagtgtaagtatgtgcttcttcctatctgtatgttgagagattcctcattcttttttatggttgcagataattcattatgcagwtatacaatttatttaaccagtcccatattgatggatattaggttatttccagtcctttgatgtgaccaaaaaagattataataaaaaatgctgaaagaat

SEQ ID NO: 1080 - DNA, 201 bp, Homo sapiens
tgcacccctagaggcctaggaatcaactccctccttcttgccatatccaaaaatattaacaacattttgaggggagccttaaaacaagctaatcgaccccmaaaaaacacatagatcccaggcatcagagaaggagaattcagtcttcaagaccactcccagctgggccttcctgctttcttctgagcctaaacccagtga

SEQ ID NO: 1081 - DNA, 201 bp, Homo sapiens
tctcattctatctatgtccacaagttgaatttttaaaccatgcttcaaggatcaggtcaaactccactcctgtcataaagcttccttaagccttatagcaraaattagtgcttcctctatgttcccgtaattatttatttctcagatgcacttaccatattccaccttgcattatagttgattgtgagtatatctttttac

SEQ ID NO: 1082 - DNA, 201 bp, Homo sapiens
aaagtaatctctggtaaactcttttgttttgttgttcttgcttgactttccattctacttcacggatctcaaattaaagctatagatttgaagaaggaaaytgatatttgagatttgtaggacagggtagatctcatcatataaaagaagctcaacaaataccttgtaattgatgctacatgcttaacacaaacaaacaaa

SEQ ID NO: 1083 - DNA, 201 bp, Homo sapiens
gaagttaactccaagcctattgatttgcaagtaatatcaatcaaaattcaaaaatttttaaaaatgcaaaattatacaaactttccagagaatagaacaaytgggacgtactcctcacataattttatgtggcttgatataaaatcttgacaagaggactatgaagaagaaaacccctacccaaagtcactcatgaacgta

SEQ ID NO: 1084 - DNA, 201 bp, Homo sapiens
ccccagtgaggtgaacctggtacctcaattggaaatgtggaagtcacccatattctgtgtcgctcatgctgggagctgtagactggagctgttcctattcsaattatactggtttctaaaaaagattgtaatatattgttgagagtgaagggagttttatatcaataattaaattattttaaaatattgtttatttcattt

SEQ ID NO: 1085 - DNA, 201 bp, Homo sapiens
catctgaactgaagatgtaaaatgtttgaatcatcaatccatatgtcatttaaaccagaagactagatgtgataaccaagaaaatgaataacgagacaaartatgagatctaaggattgggccctatagcaccccaacatttagaggttaggaaactgaggacgaactagaaaggagactaagaatcagtgaccaaaaaag

SEQ ID NO: 1086 - DNA, 201 bp, Homo sapiens
atggtgcctacccagaatgagggtggttctgtctttcccagccctctgactcaaatgttaatctcctttggcaacaccctcacagacacactcaggtacartactttgcatacttcagtcaagtagacagtcaatattaatcaccacattctccaacgctttctcatacaggttctatttctccactatgaacagtgagat

SEQ ID NO: 1087 - DNA, 201 bp, Homo sapiens
tgtctttagtcattgcttctacatggcaataggaaatatgaccataaaaacctcagtgaaagtaacccacatttagagaaggcttgtattccttaatcccrcccctctacacaccccacccattcaacccatctgtagcctccctttcagctgttcttaaaagaccttcccttttaagggaacttacattttcccttcaat

SEQ ID NO: 1088 - DNA, 201 bp, Homo sapiens
gcaataggaaatatgaccataaaaacctcagtgaaagtaacccacatttagagaaggcttgtattccttaatcccgcccctctacacaccccacccattcracccatctgtagcctccctttcagctgttcttaaaagaccttcccttttaagggaacttacattttcccttcaatactaaatcccaaaagctaatagcaa

SEQ ID NO: 1089 - DNA, 201 bp, Homo sapiens
tggttattatcagttttattttacgttacctaagtagaatttaagcctttcagttaaaatatgactcccaagcaaaaggaagaggattaatggattaactrttgtttgtgttatcaataatattggcaataactatttgtctatggtgctgtgtcagttacaaggcactctgccatgcattcttccatctgatcctcacca

SEQ ID NO: 1090 - DNA, 201 bp, Homo sapiens
attactaaatgagtatgtgaggacagagcagaggaaaaggccaagggttgagcactgtggtgctctattatgagaaagttaggaaggattaaagttggcastgaaggggattgagaaggagtagctgaagcggtagaaggaaaacaagaacagtgtgtcctggaagtcagtggagtaatcacttgtctcaaatgctgctaa

SEQ ID NO: 1091 - DNA, 201 bp, Homo sapiens
aaaagagcttcattaggaagtcttgggcctaattgttttttgttttataaattttaaatgactgctctgtgatgagcccatttcagttgaggctgtattayttttcctgtgggtaaaatgacatactgagctgatatggacatcacttctcccacttttgctattttaaaaatacagatatgctgcataaacatagcaaat

SEQ ID NO: 1092 - DNA, 201 bp, Homo sapiens
tcttagttctaagatcagggctaaagtttggagttttaatgccctcactaggacttgacactaggatttggacccacagacggaaattgcagctgaactcmctgaagcagggacactagaaatgctttcagacagtgaaatgggggctagaaaattcttcctgcaagcctacagaggcagctagaaaatttttctcttagg

SEQ ID NO: 1093 - DNA, 201 bp, Homo sapiens
gacttgattcctgggcatttttacaaatggacttcaatgtgtacatttaatcctgaatctaaattacagatgtagaatttttggcataaaaggttcatgcrtgaatgaatttatctcttgcaacccctacagttcaaataatattatgttagtcaattttttacatggacagactctctccttgaccaaattttggaaagt

SEQ ID NO: 1094 - DNA, 201 bp, Homo sapiens
gtttctttctttttccctctgcattacaaatacatacgcaatactttttcaggttgttttttccaaaagcaacaataaactactagtggagtaaaaaatayggaactgaaagtccaactgtttgattaagtgtatgttataaccattgtatgactttgagtgaatttctatttttaagaaagtggtatttggaaccacaat

SEQ ID NO: 1095 - DNA, 201 bp, Homo sapiens
gtttgacaaattgaaatgctaattatgatttatcatttccatgacatcaaatatccagatagtaataaacgttgatgactaactatatttttcagtttcasccagatgtttggcatcacgtaagataccaccttagttttacataaaaataaaatgtttcttgagtctggcttatcataatggggaggaaactaatatgaa

SEQ ID NO: 1096 - DNA, 201 bp, Homo sapiens
ccaagtaccagtgaaaatctgtgaaatttgaaatgtttaccatttctattaatagagttaattagtaccacaatttaggagggcaatatggtattatctastatctttgaaggtgataaaaccctgtcaaccagcaattccacatccaaacatttaccccaaaaaactcttacaatgtatagagaaaaaccatctaaaatg

SEQ ID NO: 1097 - DNA, 201 bp, Homo sapiens
ttttgtgaaggccttttctttaccaaattagtaatatggtgaatattaaactaaacctgagtcatactacatttgtttttaaattttgtagggaagggggraatagcaaataatattttatgctagtaatcaggcattatatcagttgttgtaaggaactacatgaaagttggtggtatacaggttaccagtagtaagttt

SEQ ID NO: 1098 - DNA, 201 bp, Homo sapiens
gggtttcagatttaaaaatcaagagtaagaagttttacaatatttactaaagattacgattagtataccacaaaacatctgaactttagatattatttatrtgaccttaaaagtcagacctttccctgccaatgacttaacttctgtctttagtgctattttgtttgaaggcttatttatctgctatgaagtgatttttct

SEQ ID NO: 1099 - DNA, 201 bp, Homo sapiens
tttctttattttcaattaaagagggacccttattaaaaatatttttattaacctgttagtcttatcttggcagctataaaatattatatagttatatttgrtacatgtgagcatatgtgtacatatacaaccattaagccataatataagtagtaaatattagttttaatgaagtgtttatgaattgggacaagaatgtct

SEQ ID NO: 1100 - DNA, 201 bp, Homo sapiens
tcaacacagtatcatttcagtataaaatctcatattttgaataaaacaaacatatctttacacattattaaatgaactacgctgacaaattttgtttcttyttttgagaaccagaaaaacaattatacttagatgggccatctaaaatgtccttccagcttgtggagtaggttgtgtttgtttttcaatgaacatctgttt

SEQ ID NO: 1101 - DNA, 201 bp, Homo sapiens
gttttaggttaaaaaaattctttaccttttagctttgatgaattacttcatttttatatctaataggtttttttaaccttcactttaattgatttcttaamctctttatcttgctcattttttaatctttttaatgattttaaaatgctgattttaataattttatcttggcatatttatatttatcagtttttctgcttc

SEQ ID NO: 1102 - DNA, 201 bp, Homo sapiens
acatctagcatttgcatcaaggtgagtttgtctcaaaagctctgttctagtgccccactcaagaacagatattgtcaaatttgtaaaagatattttaactrgaatagacttgatttttattgctgatttaatctattacaaactattgcttttctattctaagctgttgtaaaaattattgctttaatatgatcacttaat

SEQ ID NO: 1103 - DNA, 201 bp, Homo sapiens
tcgacgaggtgagagctgcagcagaatgtcactgctctgataaaaggacaactaaaagccaaatatgattattttcagaagaatattttgcagtaaatgtyattcatgtaataaatttattctttaatctatcagtgtattagcgttccctccaggaagtagtttttaaactcatctcaataattactttcatgtttaatt

SEQ ID NO: 1104 - DNA, 201 bp, Homo sapiens
gaatagagtatctactgtatgactagaggtatagctaagaaaaaagactatagggagaaattaatattgtaggacaaagcatttaattctagaatgatccyactaaggtaagaccaccgtcatcggttgcaaaattgctgaatcactagggttaatagttacagatcctaaatactcctcacatgttttctttcctcgtta

SEQ ID NO: 1105 - DNA, 201 bp, Homo sapiens
gaagcagctcatgcatgtctagtaggttcctggtagctggtaccctaagccctcagtaatcagtgttttgtcctgactaggtaggatgctttaaattagasgtgtagctgtaggcctgaccttggctgaagcataaagatgtaaaaacaaatcattatgcattcccagattcctcctttaaggttccttccatttctgggc

SEQ ID NO: 1106 - DNA, 201 bp, Homo sapiens
tcggggcatagtggacactggtgatgaatttggtgtcagatccagaacatgttgtctgtacccctcttacagcagtgattttcttccaccttgtaatatamttatctgaagtccgcctcatcagaaagtacatagggaaactatcgtgactctatttctccaagtagaaactgtgctaagggaactaaagcaaaaaagaaa

SEQ ID NO: 1107 - DNA, 201 bp, Homo sapiens
gtagcaacaaatatggagcatttagaacagtgtctggcattgagaaaacctatgttttagttgttattagtattaaaagaaaggaattatattatacatayttttctttacccacaggctctaatacagaaatttccatatggtagtaattcattacagattacctagctgttaatcattcagtgccatcattgaataatt

SEQ ID NO: 1108 - DNA, 201 bp, Homo sapiens
agtgcaagggcctttgaaatcaggcctggtttggaatcttggtccagcaatcaatagctgtgtaatcttaggtaactctttgaagtttagtttccgcatcyaagaatgaggaagtataaatacatatctgcccacgttggttgtattaaatgagataatttacataacacatccgactaaggtgcagatgtaataaatgac

SEQ ID NO: 1109 - DNA, 201 bp, Homo sapiens
gaagctattaaaataagcttcttatccttagggaaactatttcaacactagagctatcatcaaaagtccttgagacaagtaacccaggagtggaatggttrtgattacactttataagcaaacttaaaaagatatcaggagctgctttactaggcccctgctatgaagtgaaaactggagaaaaatctacagcaaagcatt

SEQ ID NO: 1110 - DNA, 201 bp, Homo sapiens
aattacttgacaggaacttaagcatccgtatttgttgccaggtagtcttctgtgtggttaaagtacagaatgtactcctacaaaagcagagaggcggcccrttgccacacaaaagtgttttttcagatggcttatggttagaaccaatatatttttctagcatacagtttgagtgataatagctcacattccccgatcaca

SEQ ID NO: 1111 - DNA, 201 bp, Homo sapiens
tgtggacagtgcagtagataggaaataaaatatatagggatcagaaaggaagaaataaaactcacttatagatgatatacttatctgcttgtaaaatcaaragaatctacagacaaattcttaatcagtgagtcaataaggagactatatgcaaaattaatatacaaaagtcaatcatgtttctttatatcaacaacactt

SEQ ID NO: 1112 - DNA, 201 bp, Homo sapiens
gtatatttcatagatggcattgatacagtaaaatcctttattctgtaaatggcatttatatagtaaaatcttttccatggtgaatgattattagtcttaartgaaatacaaagatttgattttataagtgaaatatttcttaagtaaactatccttggctgccagtttctttcttaaaagtttaatatttcccagcaactt

SEQ ID NO: 1113 - DNA, 201 bp, Homo sapiens
gacagctaatgcatgcagggtgctttctatcaggtgtacagatgatcagtgtttcccaggctttaaaagtccacaagacaggcttggaaggccaattccasgtggtaaattgagactgtattcagagcatgcacagacaggagatttagtcctagagacattagatttctggtttacctgcacccctagaggcctaggaat

SEQ ID NO: 1114 - DNA, 201 bp, Homo sapiens
aagatggccagagaaactgaatgagaatggaatcctgaggagaaaacaccaatatttaagagacctggttctctcagtgttgtggaacaggatccactgakatggaacagaagggtaagcttctgttaagctaggtaaggaagcttagggttgtgaaagaaggtacaaagacactgcacactgacttttggggaattacct

SEQ ID NO: 1115 - DNA, 201 bp, Homo sapiens
tttgtggtagttctttgataatttgtcctcttttgatacccttgattagctttgtttaccgtttccttttgcttgcttttctttttttcaaatctctttayttcctgtggtgtttatattttctcttttttatacttaaatgaattaaattttaatttatctatttttaaaataatggactatttaagcctataagtttac

SEQ ID NO: 1116 - DNA, 201 bp, Homo sapiens
aaattttaggctattttttttatttttacttattttttttaggcttttgtttaaaacctgttttttgaccagtgtttttccttctctttctaggactccarctgcatgtgtgctagggcgttcattgtatctgaggcagtgctaagtaattttttttctttctccgttctttagattggatcatttccattcatctgtcat

SEQ ID NO: 1117 - DNA, 201 bp, Homo sapiens
tcttgtggaaatataggttatgattcagtagggcagagctgagacgctgcacttcaaaaactttccaggtgatgctgatgttgccggtttgtgggccatcraataatttggttttatgcttgattaatgaatcacaagccatagttttaaaaatgcagtgctataggagaaaactgattctacatactgttttattttcct

SEQ ID NO: 1118 - DNA, 201 bp, Homo sapiens
atgtagagctttgatattattttgatttcctatgtgacagaattttatatatacagacagaatatttttcttcctcttttcatcatctgacattatggtgrtccttagaattgcaaatacaggagaaggaagacacaaacccaagactgtattaaaaaatgtttcagaaattctcctttgatataacattgttaaggttat

SEQ ID NO: 1119 - DNA, 201 bp, Homo sapiens
actgtgttgttttggctcacagaatataaagcgtgtatgtatatacctgtgtttccacatagacacactctgttacccttatatgtattgtataatcacaygtgtagatgttcattgtatctggagtgacagttgacaccttttaggggcattttacatgttttaaaacctgacatccacttacagcacttatctactact

SEQ ID NO: 1120 - DNA, 201 bp, Homo sapiens
catgttttaaaacctgacatccacttacagcacttatctactactctcttcaggataaactacctttattgcaagacttttgctaaaaattcttagattaygtcaagggaaaaaaatcctctattgctttttaaagaaaaaattatcagaatgatttaattttgtgttattttttatctccacattagtttgttatttcag

SEQ ID NO: 1121 - DNA, 201 bp, Homo sapiens
cattccccgatcacatgccttgtgccaagtaccattctaaatgccttgcatcttgtaactcattaaacctttacagtaacctcatgcaatgtacactcttrttgttcccattttgcaaataagaaaactgatgggcaatattaccttgcccaagtttatacagctggtaagtggcagagtcaggatttgaacccaggctga

SEQ ID NO: 1122 - DNA, 201 bp, Homo sapiens
atagggccctcatatatttgtgcattttgttatggtgttggtgcatttctttattgatttacaagagttctttgagtattaggaacatccttcctttatcygtgccaacagtaccttttattttgtcacacagtttattcttcatcagaattctttgctcttgagaagtccctgtgagagcctgccagccttctacacctt

SEQ ID NO: 1123 - DNA, 201 bp, Homo sapiens
tcagagaaaaaaaatcaatgaaaataaattagtgttctttctatcatctcttgcaggaggtagagtgggggttggggtacacatctattatttataacttyatcgtacatgagtctttaaaataatgcagtataagtcaacatataaatatgttttttgaaagtactcaagttcaataaacactcatttaaatatataaaa

SEQ ID NO: 1124 - DNA, 201 bp, Homo sapiens
tataatgtatctttaatttactagctgattttaaaatattctcattaggccgggcacagtggttcaccccaggaatcccagtactttggaaggccgaagcrggcaagtcgcttgcggtcaggagtttaagaccaacctggccaacatggtgaaaccctgtctctattaaaaatacaaaatttagccaggcatggtggcagg

SEQ ID NO: 1125 - DNA, 201 bp, Homo sapiens
tctttaatttactagctgattttaaaatattctcattaggccgggcacagtggttcaccccaggaatcccagtactttggaaggccgaagcaggcaagtcrcttgcggtcaggagtttaagaccaacctggccaacatggtgaaaccctgtctctattaaaaatacaaaatttagccaggcatggtggcaggcacctgtaa

SEQ ID NO: 1126 - DNA, 201 bp, Homo sapiens
atcctgttaatttggtttagcaagaatcccccctacctacccctgatgtctcctcttaatgattgttcgcccctgatccttgctcgtggctataaatctcyacccttttccttggcactgaatccctacttgttcatgttgtattgggaatggaggctagttctttactaaggttgctttttctctattgccatagtttct

SEQ ID NO: 1127 - DNA, 201 bp, Homo sapiens
tgtctaaagcacacatttcttcctaaaagaatgaaaattggttctttgggaacaaaaatatcatattgattttatgtaaaggcaaacattcacatggtgcrtctgtacataaaatatatctggagtattaaagtttcatggtggggatgattatgaaaaaatgactatataggctccatagggacatgatgataaaaaata

SEQ ID NO: 1128 - DNA, 201 bp, Homo sapiens
cacatggtgcatctgtacataaaatatatctggagtattaaagtttcatggtggggatgattatgaaaaaatgactatataggctccatagggacatgatrataaaaaatagattaagtagattgaaaacactagtctaaagtgaagtgatgtgttttaatatcataatatgtgagaatataaaagtatttacgtatggat

SEQ ID NO: 1129 - DNA, 201 bp, Homo sapiens
caagaaaagaacaaaattatggttttactgtgtgtatttatttatttatttatttcaataaatgccctttagtagatatttttacatctggagacattctyacatctggaagaggacactgcaacagtagcctattttaatcttgtcatgaaaatcttgggatacatcttttttgctcaactccctggtttttctgtctta

SEQ ID NO: 1130 - DNA, 201 bp, Homo sapiens
aagtcattgactataagtgctgtctgactctcagtatttgtttatttcaagtaccatatgctagaaattggctcttttgcagtttggtgtcatattatttrtgcaaaatcagttggtatgtagaatctcacacataatataaattgacattgatctagttaggaacatgtgcttttatttttatcaaagtcttataataga

SEQ ID NO: 1131 - DNA, 201 bp, Homo sapiens
cttataaagagtaaaatagatggattttttatcctgacaattactgtgtgtttagtccctaaatttaatatagttaataatatgattgggttttgctattwgtttcccatttgtgtcacaaaatttttgttcccattcttccttttctgtctacttttatgttaaacaaatatttttcagtattccattttatttccttta

SEQ ID NO: 1132 - DNA, 201 bp, Homo sapiens
gcataattttccacaggctttacagagtccctttgtctcactggctttctgcattttaaaaatccctttactgttattttatttggaggaagtgaaaaaaygcatatgccaccatagaatactacgctgccataaaaaggaatgagatcatgtcctttgcagggacatggatgaagctggaaaccatggtcctcaggaaac

SEQ ID NO: 1133 - DNA, 201 bp, Homo sapiens
aatgaacacagagggggaagaagtgtgtttactctaggatcacctctcaatgggtcacttggcaagggcatctttgcttcttcgtcagctccttttgacaygggggtgaagggttttctgcaccacactttgaccacaagcatcaccaatttcactgaacccaacagaaatttggaccctctgggggctctctgcgtggca

SEQ ID NO: 1134 - DNA, 201 bp, Homo sapiens
attctgtggatcttcccaagggtgtgaagtgtccacagcgtctgccttgggagtttccatgcccaccagaaccatgccccaagcccctcaagcactctgayctaggaaagccagtgaagcaaggatgacaacatggccctttgatactagctgagggacagacacaggtcctgggagaccagagaaagacgaggggcagag

SEQ ID NO: 1135 - DNA, 201 bp, Homo sapiens
acatagttattaggatgccctttttctttctttttaagtcttttatcaatttggctttttggaaaaatatctgatggaatacttgtttctgctatattagytgtgtgagactagtgacaggagctgtgggaaatgaatgccaaatgttcttaggcattgatgggaatttcagggtgtggtcttcaagttcatttaagggaa

SEQ ID NO: 1136 - DNA, 201 bp, Homo sapiens
ggcctgggtctccctggtggggtgtgcatgccacgccccgtgtctggatgcacagatgccatggcctgtgctgggccagtggctgggggtgctagacaccyggcaccattctcccttctctcttttcttctcaggatttaaaatttaattatatcagtaaagagattaattttaacgtaactctttctatgcccgtgtaaa

SEQ ID NO: 1137 - DNA, 201 bp, Homo sapiens
cacttctgagttgggtaaagaagtctgtatcagtgtaattttctaatccgtcctgcattatctatggctcttggttcatacctgtcttgaagttctgtcaygttctgtctcttgtcctcagtagagatgctacagcagtggctcgcctcaggcagggcagggcagtggggtggctgtcctgggggcaggcagtaggggcac

SEQ ID NO: 1138 - DNA, 201 bp, Homo sapiens
tcaactgaagatattgttctttctcgtattcaggagctctccttctctccgtatttaatctcctgtacagtaattaataggttaagagatggggacagtamttcaacgctagaagaacacagtgaagggaaacaaataaagaatttgccagaagaaacattttcaaggtatgctttctatctgagcctataactaacccat

SEQ ID NO: 1139 - DNA, 201 bp, Homo sapiens
gtttgcttggttcaccactgaacttaaaatgcttttaaatgagggaaggtgacgatgagatgattatgatgatttgcccttgagttacatagctggtgtayaggaagctgtcgtttcttttggcttacgtagaaatgtttgtggtgtctaattccacagatgcacattgactctcatgaagcccttggagtgttaaataca

SEQ ID NO: 1140 - DNA, 201 bp, Homo sapiens
gagaaggtgccagctctgggacagtgttggggtagtgaggagggagcccagtggagagaagtcgggcttcctgcttcctcacagtatgtctgtcctgactsaactcggatgatgtcacttccttttcatcttctcaggtgtggaagcttggatggtcacccaaaccgggaggggattttggcacagcattccctgagatcc

SEQ ID NO: 1141 - DNA, 201 bp, Homo sapiens
cttatcacagagagtgggccagagggctgggaaccaaggccagagctcaggttcaggaccattccagcaatcccagcagaaaatggggagaattgtatggyataggcggatatgaaggtagaatctgcaggccttcagtggccaactcagagtctaagtggattccacagttacagcttgagcagctggttgtaggtcatg

SEQ ID NO: 1142 - DNA, 201 bp, Homo sapiens
gaagacaagtggaagcgactgtctcgacagatagctgacatcatcctcccaatgttagccaaacagcaggtttgtccccgcagccttggcttgttgttgcrtagtgatggtagcttaaggtccttgtgaaaggtgggtggctggaatcagctcttccttcagtcctaatctgtgccttgatagcagttctccgtgctagtc

SEQ ID NO: 1143 - DNA, 201 bp, Homo sapiens
taggaattatttcttccagtagcgccagtgtaacctgaaagcctttgaaagagtagtttttgtatagctatctgaaaggaatttctttccaaaatattttyccagtgctgacaacaaacacgcagacacaccctgcaaggtgagtgtacggcgccgcacagtggaggcatctgctgcagccgtcgatgtttgtgtctttgg

SEQ ID NO: 1144 - DNA, 201 bp, Homo sapiens
ctttcctatttgttcagaactttttaaattacctcagaagcacatgaaatttaaaggattttaaaaaaaacttaaagattatttcacatagctcttgcacrtttcttgataaatgaatcctcaggtattcctctgtttttgttactaatagttacttcttatgggttttttttcccctgaaaatcatttatcaaacgtatg

SEQ ID NO: 1145 - DNA, 201 bp, Homo sapiens
aatacacatcagtaaagtgagagaaagtttctccaggtgcggttcaagatattagaaactaatgactgatgtacacagaccaccttttggtctgaagcatytctaagtgccactggctgacatgcagcccctacagcctccaggcttccagccctagcatggagcatcactctcctatgcttccctggttgcaggtgatgg

SEQ ID NO: 1146 - DNA, 201 bp, Homo sapiens
tttgtggagcatttgcatgtggaaagcagcaaaaacataatgggaacgggttcttttgttatgatttttaaaaatctcttttgtaacatccttcccgctgygccgtttctgcatattcctttatgtagctttcaaactcctcttaggagttctggtccctacagggcgtgggagcccaggctttacgtagctttcaaactc

SEQ ID NO: 1147 - DNA, 201 bp, Homo sapiens
tggttctggttatccttagataatgaagtaacagtgtagcaaatttcaaaacctcttggaaatgttattttaccattcaaaaaggcttactaaggttctcrttatgggtggccctctttttgcaaaaggttttcaggcttaagctccatttctaggtgctccaacactccattatttgtatatgtatggaaataaaagctg

SEQ ID NO: 1148 - DNA, 201 bp, Homo sapiens
cacacctttcactgtcgtcttcggtgtcgtgatgtgcttggcagtgttcgttttcatatacccactttgaacgttgtcagtggcagccatgtgcttctcargctctgcatgtgtgtctgtgtatgtgaaggtactggttagagacgtttcaaaagagaagagagcatattctttactctcagcaatttgtaatcttctcag

SEQ ID NO: 1149 - DNA, 201 bp, Homo sapiens
tgtttggggaacatttttgcaaaatctagagttagtttaaacagattatcaattattaccataattgatcatctgcagtttcaagctatctaacaggttcrcttacctctttaaaaaggaatggaatttagcaggacagtaactgagacccgtgctcctggagtccatgtgggagctgtgtggctctgcacaagcatttgc

SEQ ID NO: 1150 - DNA, 201 bp, Homo sapiens
agacgttcgggtatgacagcaaaacgctgctactccttaagaggcaggcgctgttggcataatcagctgggaggattgtggggtccagcgcagcacttttyggctcagtccatgattgagccaagaggccatccttcccttcactccccaggaggacgaggtctgtcactgtggagggcagaggacaccagaagctcctct

SEQ ID NO: 1151 - DNA, 201 bp, Homo sapiens
gcctgccctatcacaggcatcggagcttgtcacctggtttaaaagaagagagttgtgtggggatttgggatgcacgtttttcactcaaaagtattttagcrtagagctctgtgattccgtagctatttaggagtttaagcaccttgaaggctttaattgcagaaagttctatgtggacgtgcaatgtgttatacgcagtgt

SEQ ID NO: 1152 - DNA, 201 bp, Homo sapiens
aaccgatttaaagagagggctttcctgtggtgaggtaagagattagctggtcattatcatagagccccctctgcctttgtgcagatgggctgtgggaatcytggggttccgttgggtcctttgtcacctcactgaaggcatgtaagctgagctggccagaccgtgagctgatcctgccacttgaacagcatcaagcctgcc

SEQ ID NO: 1153 - DNA, 201 bp, Homo sapiens
atggtttgggatgagaactatctggcctccactggaggaacaaacacaggatgttatcatctaagctccatggccaagacagaatggaagtcaaggttgcrtatttgccgtagacttcaacacagtgtcgtaatgcgtgacgtcaataacttgtttctagtgtcttggaagttgatctttagtcgtaaaagagacccttgg

SEQ ID NO: 1154 - DNA, 201 bp, Homo sapiens
gtgtcagccaccacgcccagccatattttcagatctccctctctttgccctaaaccactgtgcttaataagtagtttttagtggccagcagtctccatgtwtaacacattttagcaaaatggaaaatactatatgttttaaatttgaacgtgagattatactgaaataaaaatcatctaactgggattctttaaatagtaa

SEQ ID NO: 1155 - DNA, 201 bp, Homo sapiens
cgctgacgtcagggaagttgaaacccaagagaagccagtaaaagtgagtctcagattgtcaccatgtgctggcagttttacacgctgtcagtaataaaagwcttctccctgcagggcagcctgcctccaataaatacgtgtagtatcaaatcctgtcttccctcataaattgtttggaagctccccaaggacagtgatgag

SEQ ID NO: 1156 - DNA, 201 bp, Homo sapiens
acttctgaattcctgccctgcgaacaggactggatacctaatagacaacaggtacttgataacagtttattgaattaatgagtgaatgaacagatacataratgcatgaaagaatggttgtaatgtatataacttggatttcaagactttttactgactgttcaaaataagaaattgaaaactttcctctgattttcctct

SEQ ID NO: 1157 - DNA, 201 bp, Homo sapiens
atgttgaaaaatgccgtagagaagatacttcttttccacctgttttcaactcatatcatcttgaatttcagggcacctttccatgctcctagtgcttgctrtctgtttattattttccttcctgaataccctgaactccagcatgttctgctgtaattctggcctccctggcatcttggactcctgtttcctttgctctgt

SEQ ID NO: 1158 - DNA, 201 bp, Homo sapiens
gacttctgcaggggtctcctcactgttaaagagcagattgaaagtgaagaacgtgggctaagtgtttaggtcgatatttaaccctgctaggttttggatastaagtgaaattgaggccattttggttgaagttgacagaaaccactatcagggatccccaagactaccccaggcttttctagaaagactctcagctaagat

SEQ ID NO: 1159 - DNA, 201 bp, Homo sapiens
cagttttagaacccataaaggaactctgtactctttacccaaaacctccatgcctccagctgcaggcagccactaacctgccttctgtctctgtgactctrcgtcttctggacattactgtggatgggctcatacagtcagtgagcttgtgactggtgccttctaccaagcagggttttcagtgtagcagcctctctgttt

SEQ ID NO: 1160 - DNA, 201 bp, Homo sapiens
tcggcaatgggttaagttggcagaaatgaaggcctgtttacgcactgagggcagaagcaacagggaggatcagttcatgacacaggagacacaaatcgccrttgtggtgttcacagacatgggttaggattggctgcatggatgacagagcactgtgggttctcccagagttgctggggaggaggcagagttggtgagcac

SEQ ID NO: 1161 - DNA, 201 bp, Homo sapiens
tggtgtacagttcacaaagcttaaaaaaatgctacctgccatttcatcctcagtgaggaaggtgatacacagagagaccaagtgactgtgtccacggcgayggcgctctgcatttcactttagcggttaatgtactctacctatatttttactttatatttaccatatatcttttcatgtatacttggcgtaagtgcttta

SEQ ID NO: 1162 - DNA, 201 bp, Homo sapiens
tggtttggatttgatgccaggaggagacagcctcatttctaaggactagtcttgcctttgtgggataagggtggtgtgttctgtgtccttctacatgtccragcgatctctgtgcagctcaaatgtggtcactgtcttattgcgctgatttcctctccttccatctcacaattgaggcaaaatattgttactgttgaagtg

SEQ ID NO: 1163 - DNA, 201 bp, Homo sapiens
caccaaccttggcctgccaaagtgctggcattacaggtgtgagccacctcgcctggcctattcatcactaatcagaatttctatgatcaaatgacatgaaycattgtttccacaactgcagtggaaggaaatggcctggcagtgccagtttcagaagcagcctgcccccagtcaggcacaggccactgtgcccccagtgta

SEQ ID NO: 1164 - DNA, 201 bp, Homo sapiens
gttcctagagacaagaaacgttgataatcaattagcatgtatatgtaatcaagtggtaaagggctgacatcagccaccacagtggaaatgcaagctcttcmtccagttcccacatctaaggcattcataaacccagtgtccattgattgaacaggaggactctataatcccactacatatacatgcagtaaactttcttta

SEQ ID NO: 1165 - DNA, 201 bp, Homo sapiens
accaaagcgatctggagccattcatcaggataagtacacactagtataggagatacccaaacttttcaaacattgttaaatatgaggtctgagctaatacygacaccaggaaaacctaaatctgccatgattctttggtaagaatgggacttccatcggacaagtgaaacatggagactcctaggcttgagtcttttatac

SEQ ID NO: 1166 - DNA, 201 bp, Homo sapiens
tgcctccttaaagattccatcgcattattaacatggtaggtcactggttggaaatgcaaacgcatagccaattagtggaagacaaggtgagcttgccaatygataatcaccacaccacctgttgcgctttgaaaaattacctcacaacattcttgggtccttaggtaaatccttaaacttcatcctgaagaaaatgaatca

SEQ ID NO: 1167 - DNA, 201 bp, Homo sapiens
cttcctacaatctgtaaattctaataaggccctgtaggaatagcagaaaataccatagactctttctcctgagagagacaatgttgagacgggtggtaacyggcccagtaagtctggcccaaaaatatgactagatcttctgtctcctgatgccttctttgcatcctgaattcttttcatatggatgcccttcaaagctgg

SEQ ID NO: 1168 - DNA, 201 bp, Homo sapiens
tgatgtgaaaaaacagaagtattaatgaaatgctgtgggaacataaactaactagggagtagtaattctgccttggtggtacttgggttttgattttgatyagagaaaattagaacaggtaatatttaaggtagttttgaagaatgagtaaaattttccagaaagtttggggaatgtaattcctggtagagggaagcctgt

SEQ ID NO: 1169 - DNA, 201 bp, Homo sapiens
ggtgagtcagggtccctgacctatgcttaagagccattgccaaagattgactcagggaaatgggtagttccgtgccccatcctcttccctactcacttccrcttgatactagaagtgagactcactcagtgtccactttccccacccttggagagctcacagggagtggagtgtatcactcacgtagccatgtgctgctct

SEQ ID NO: 1170 - DNA, 201 bp, Homo sapiens
cactgcgaaaatctgcagtttcactcctgaggccagtgagatcacgaacccaccagaagaaacgccgaacacatctgaacatcagaaggaacaaactcagracacaccacttgtaagaactgtgacactcacggcgagagtccacggcttcattgttgaagtcagaccaagaacccaccaattctggatacactttcactc

SEQ ID NO: 1171 - DNA, 201 bp, Homo sapiens
ttggtctgggaatattcagggcatcaggggaacgaggccaactgaggataagcggtgggcatggagagctgaggtacagaggcccaagaaatcgtcaggcrtgaggaagcctacatagagagagctctgcaaagactcctggaaagacagaggtggagagaaaggaaaagagcacctggcacaaaagatgcagaaagcatt

SEQ ID NO: 1172 - DNA, 201 bp, Homo sapiens
acttaagtcactttttctatcttttgctgtgtaatacaaagacttcattttatactagcatgaggtcgcccctgccctcaagcctaatgggtcagggaacyaatcccagattgccacctttgaacgtcaattttctgaaacctcttgttataccaaatactgtaacagtcagagttcacttatgaaaacagaaaccacttt

SEQ ID NO: 1173 - DNA, 201 bp, Homo sapiens
gaaattacagactttggatattccactttaccttcttggaaatgtccctcctgggcccttctcgctgctcccatctggactggaggcttctccctgtggarcagagtcactgtcctaggatctccctccaccgccatctggggcagtgctttacatgcagtggagccacctggggtccagccaaaatgcagactgattcaa

SEQ ID NO: 1174 - DNA, 201 bp, Homo sapiens
cttcagcaaatacatcagtcagctggatgaaggaggcaggtgtgagccagcaaaaaaaagcttgtgattttattggagcatgaatttaaaagtgttgatgwggctgggcgcggtggctcatgcctgtaatcccagcactttgggaggccgaggtgggtggatcacgaggtcaggagtacgagaccagcttgaccaacatgg

SEQ ID NO: 1175 - DNA, 201 bp, Homo sapiens
tagatacttctgaatgaattggtgaagttttagttcatgttatttgaagcatcttttgagtttttaatatttgttttgtgggagtcttatgtttgtagatkatttgtttataattgtgaattaactgaactaagataaaacacaactgcgcattgtcaagcagtaacattactaaaataaattgctaccaattttatcttt

SEQ ID NO: 1176 - DNA, 201 bp, Homo sapiens; identical to SEQ ID NO: 874

SEQ ID NO: 1177 - DNA, 201 bp, Homo sapiens; identical to SEQ ID NO: 875

SEQ ID NO: 1178 - DNA, 201 bp, Homo sapiens
tcagttaaggactagccaaatttattttcaaacttcagatgtttatcatgaagtaactttgttaaaaaggagattcttaaaagcaagcatttgtttcttayaggtccgaacaaggtcagttggtgaatgtgtagcattctattacatgtggaaaaaatctgaacgttatgatttctttgctcagcaaacacgatttggaaa

SEQ ID NO: 1179 - DNA, 201 bp, Homo sapiens
gttaaattatggaaaacagcatctcccattgcttgtgtaatcctatacctacacattctcccactctaaagcctgttgatttgggggaggctggggagaakagaagaaacaattacatagatgtcagtgaccacattgctagcctgagtcccagttgccctctgggttccacagagagtcacagtcccatttttgtggcat

SEQ ID NO: 1180 - DNA, 201 bp, Homo sapiens
tactcatctttgtagcattactggtaagtaggtcgatccttgccccataggcacttagtaaacatttggtgcctaagtgaataggtgggtgaattatttcygaattagggtttccttatatggccttgtctaccccaaagatcccaaaaatataagaactttcgtctgcagagaacagaggctgagcagagaatagaaatc

SEQ ID NO: 1181 - DNA, 201 bp, Homo sapiens
aagccaccatttatgcaccagtaaagtgctggaaggaccaaatatgagaaggcacattttagcccgaacccagtgaaaacacatagtcggccctcagtaamtactgcttttccttcctcttaaactgctttccatcatttagctgccaaaagcaggtgttgccacaagagggcacttttagcacagctggaaaagcatagc

SEQ ID NO: 1182 - DNA, 201 bp, Homo sapiens
gtggtgttcagatccacatcttcattaagtaagttggcattatatgtacaccaaatttgaaaatcactaagctgtgtgatttaatttattcccttggtgtstatatccttagtattctttagtttatatttctagcattaacctatttcctgtctccagttttgtttgtccaccttgacatttctgcttgcttaactaaat

SEQ ID NO: 1183 - DNA, 201 bp, Homo sapiens
atgagggtcagttgcatcagaatcaaccctgtacttattttaaaaagcagattttttggacctctcccccggcatactgaatcagaatctctggaggtggkgttcagatccacatcttcattaagtaagttggcattatatgtacaccaaatttgaaaatcactaagctgtgtgatttaatttattcccttggtgtgtata

SEQ ID NO: 1184 - DNA, 201 bp, Homo sapiens; identical to SEQ ID NO: 880

SEQ ID NO: 1185 - DNA, 201 bp, Homo sapiens; identical to SEQ ID NO: 881

SEQ ID NO: 1186 - DNA, 201 bp, Homo sapiens; identical to SEQ ID NO: 882

SEQ ID NO: 1187 - DNA, 201 bp, Homo sapiens; identical to SEQ ID NO: 883

SEQ ID NO: 1188 - DNA, 201 bp, Homo sapiens; identical to SEQ ID NO: 884

SEQ ID NO: 1189 - DNA, 201 bp, Homo sapiens
ccaagatcatgccactgcacttctgcctgggtgacacagcaagactccatctcaaaaaaaagaaaagaaaagaaaatgtgtagcactatatgaatgtaagytggatgtactattttatttcatatctaaataaaaattacccttattccacacccaaacttcctatattaagatgctaaactcacttgttattttgaaaga

SEQ ID NO: 1190 - DNA, 201 bp, Homo sapiens
agtgtgggacttaggataggttacttaacattgttaaacttcagatgttattacaagaataatatatctaaagcgcttaacataatatttggcacataatmaacacaaaataaatcttagttaatgtcattcataagattctcaaaaaagtctctgacctataactgaaaatgtacaacttgccacataattttttctttc

SEQ ID NO: 1191 - DNA, 201 bp, Homo sapiens
cagaatatccatttgtaatgggaaatagaagttttggatgacagtttcttcctagttcttcctaagaaaatcttttcaaatgataatcattaatttcttcycacacatggattttgagtgatgcaggttaattgtatcatctaatccagtctgatttacccatatccattgtagcaatgtgtttaacacatgagctagact

SEQ ID NO: 1192 - DNA, 201 bp, Homo sapiens
caattaatatcaacctcccagcttcctgttatatccaaagaaaacccaaactcctcaaccaggccagcaaggccacctgcatgataatggcctcttacccrtgtatcacactacctctgttatagccacactagctgcttttgttgttaaataggctagtttcttctgcttcaagggttttcagctcattctcactctctg

SEQ ID NO: 1193 - DNA, 201 bp, Homo sapiens
gggtgttaattatttggttagaaatatcttggcttaattcattagatatctttgagcatatccaaatatttgatggtagatgtaaaaataatatgtagatktagacaggataagcagtcattttatagtattggtgtcttatttattctagatagtgaagtagaagaagaatctgaagaagatgaagattatattccatca

SEQ ID NO: 1194 - DNA, 201 bp, Homo sapiens
ggcaggcggatcgcttgagcccaggagttcgagaccagcctgggcagcgttgcgggaccctgtctcattttataaaacaaaacaaaaaataaataaaacaraaatccacatttctgatttagtcctgaactagtgccaaattaggcatttgttgccctgtaaaaagtatcacgtatatgtttttcaatattatggaaagca

SEQ ID NO: 1195 - DNA, 201 bp, Homo sapiens
aattaatcatacagttaagttaaagaattgtaagttattgtaaaagaactgagctcttaggaaaaatctatctaaacattatgtagaattagctggttgcrgtgatgtttcccctgttgtcccagctacttgggaggctgaggtagggagaatcacttcagcccaggagtttgagaccaggctgggcaacatagtgagacc

SEQ ID NO: 1196 - DNA, 201 bp, Homo sapiens
tttttttttttttttttttaaatttctacttaagggcaagtaatttgagaattctgaaattaagcatgatgcttagattgcagtttgttttgcatttgctmtaattttcaaaattatttttgaagcaagacaaaagtttaatgtcagcttaagtgcttaaatatatcatgctgaccagaatcctgttatttttatatgcat

SEQ ID NO: 1197 - DNA, 201 bp, Homo sapiens
tatcttatgtacatggtaagaccagtgcctaccatgaacctatcttttttacctttttaatcattgtttttttctgatttgtttaaaattataggaatctyaagaagccacaaagaagggattttcattgatataaaatgaattctttttagtcctagggatactatggccaccaagtttatgcatatcctactttgtaca

SEQ ID NO: 1198 - DNA, 201 bp, Homo sapiens
gaatgttgaaaaccttttgttaaatctgagtaatttactgcattttccattaattcagcttagttagactgctggatccagtgcttgtttgctgtcacatrtacctaatatgcttttaacatatgccaaattctgttcttagttctttacatttattaacttatttaattttcacaacaaccctgtgaggaatatctatta

SEQ ID NO: 1199 - DNA, 201 bp, Homo sapiens
tcccttttcttttctatgtaaaaagaaacaactgtactttaggacctcatcattctcactagcacaacagcctgctctatctgatgcattcacctccagtyctgcccttccgtgatccccacctgacagtcatccacgcagcaatcccagtgatcctgtcatagtgcaaatctcatctgtagtagttcaacttagtcacgc

SEQ ID NO: 1200 - DNA, 201 bp, Homo sapiens
ggggtcttgctctgttgcccaggctggtcttgaactcctgtgtgcaagcagtcctcccacttcggcctcccaaagtgctgggatgataggcgtgagccacygagtctggtcggtttatgtttttaaaaagtccatttctcccaccttcagccagccttcctttagcttatgcagacatgattgcccttccttttgttacag

SEQ ID NO: 1201 - DNA, 201 bp, Homo sapiens; identical to SEQ ID NO: 886

SEQ ID NO: 1202 - DNA, 201 bp, Homo sapiens
cttcagttagcacaaagcaggaacacaaatacatgctattgcaatttgaaacaggattcctcagcaaaattgattctgatttttattatagttgtagcccrgagtttgctgcaagattttcacttttaccttagattaaataagagactttttatactgtcgtgcttcaacttgtatttttggtggtgatgattttttctt

SEQ ID NO: 1203 - DNA, 201 bp, Homo sapiens
ttatggtcaccctgttgtgctgtcaactattaggggttactcattctatttttttgtacccattaaccatccctacctctctcttactcctttcccggacygaccttcccagcctctagtagccatccttctgctgtatctccatgggttcaattgttttgattttagatcccacacataattgagaacatgggatacttg

SEQ ID NO: 1204 - DNA, 201 bp, Homo sapiens
aacattctagtatgtctgacataatcactaatgttacctttgaacactgggtgttctactctgtatcagctatgcttacaaatgctactagtcctcaagcrtttggtatcttaatcattgggaagtgtttgcagcctttttcagaactttaactatttaccaatgaagcaacaatcagtaagatatttattggcattcagt

SEQ ID NO: 1205 - DNA, 201 bp, Homo sapiens
gtagtaaaacttggggatattttacatagtctgtaaaatatccccaagttttactactgccaatgtagtacaatattttacagacaatattttacagactrtgtatgcccagcctttgcattctactattacaaagcttgaccctatagggtccagcaatattccccaaccacatgtcagttagacatgtttattagacta

SEQ ID NO: 1206 - DNA, 201 bp, Homo sapiens
tcaacttagtcacgctggtagccagtgggctaagtctagctggcagattttttgttttatttcaatgcctttgagcaggtatgtaccccaagccccaccaytcactctaggcattcacacctggcccctgtgagacatctgaatttgccaacctctgacctacagtatacaatccaaatactgcagctggtgtgatctttc

SEQ ID NO: 1207 - DNA, 201 bp, Homo sapiens
tatcttttgcaacaattagtaatagagctcaggagtaaaatgcttccctcatttttacgagaaggttaagttttcatttgtaattttgttatatgcaatawttgggggaatattgcttaacagtttgttcctcccatcttgtcagaggaattatctgtttggacagaggaagagtgtagaaattttgaacaagggctgaag

SEQ ID NO: 1208 - DNA, 201 bp, Homo sapiens
gaataattaaaatgtgtgattaaaatgtgagagattgcagtattttgacgtatacacacaaattaattatatagatagaaaagaaatctcagtgtgaggaytataaagaagagttcagtgccttcattcctatatagttttatcttctagtcaagccccagccccaagagattggttaccttaggaaccatctctctagtt

SEQ ID NO: 1209 - DNA, 201 bp, Homo sapiens
gcctcggccgcccatagtgctgggattacaggtgtgagccaccatgcctggctgaagattttttttaaagagtctgtttcagattattcacctcatttgarttccagaaaaaatgctgtgtatgtttcctttttttttttttttttttttgagatagagttttgctcttgttgcccaggctggagtgcaatggctcaatct

SEQ ID NO: 1210 - DNA, 201 bp, Homo sapiens
gaaattagcattcaggccttacccccatgaagtattactgttaacatatgttcggactgcttcccttcaccaatgtgaacaactttttttcccaaacagtrttaaaagccactttgcaacacttgacttcatcttaatgtacattcactgttgttacatacatatctaagtaaatcaaagttttgggtggaagtgttgaga

SEQ ID NO: 1211 - DNA, 201 bp, Homo sapiens
aaatactttaactcatggcccgatgattttcagttaaccaaattctcccttactatcctggttgccccttctgtcttttccttagaaatgttattgtagtrtttgcaagatggcctgaatcctgaaccccccatcttcaatgagcaccaaatggtaattatagattcccagctgtagagctatgtcagacaaaggaaactt

SEQ ID NO: 1212 - DNA, 201 bp, Homo sapiens
cctttattttgagcctatgtgtgtttctgcacatggtgatgggaggtactggtattacaaaaagcttctcccccgtgggtcaaatctaagctgagtgttgrgacataattgaaattcactagatagataggagataggggtagggaattctaatcagagggaatagcacatgtaaggcaaacaatacagtgcatctgggaa

SEQ ID NO: 1213 - DNA, 201 bp, Homo sapiens
aagtcagccaggtcttgggtgaggtcagctctctccctttccatcttggctcgagtggtcctttcagcttctagtttctctttcaaatcctttatttgagyctgtagcaagaaataattttgacttttactaagcacttgtagcaagagctttactctatttttttttaatcacaaagctaacatgaaacttttggttccc

SEQ ID NO: 1214 - DNA, 201 bp, Homo sapiens
cgctgaattttatatagtctaggaaacattttcacattggttgtttcagtcaaatacaaagaagttacagaacagcatcgagtacctaagagagaccaaargcatttccttctgtaaagccctgcagctgagggcttacatccgcctggtccaatcagttcatttccaaacaaaggtaggaaatggctgcatcctagtatt

SEQ ID NO: 1215 - DNA, 201 bp, Homo sapiens
atacatgtgtgttatactcttggtcctcataactcatattaatgttaggaaaatacaggagaacctagcttctccgagatgtcccctaatcatttttagaytaagtgcatgcaatttcacatacatgtggctgtgcagtacttttgcatgcagactttgtcatgtttctgaggatgggactgagaagaaatgaatgggatg

SEQ ID NO: 1216 - DNA, 201 bp, Homo sapiens
tttatgatgctttgtaccacttacacagacttgctttgttgatggctttgtcttggctgaagtaagacggtgacaccagttgacttttaaaaagcttttayacccataactttttctttcttgctgtcccatgttgactatttataacagcgtggatgcatgttgagtgcaataaagatgagctgtgatgatattcaccag

SEQ ID NO: 1217 - DNA, 201 bp, Homo sapiens
cttctttttctttattggttgatttattttttaaaaaattaccgtttatttttaataaatacatgtattttccccactcaatccaaaattgtgtttatccrtgtaataatcagtaggcaggctctagattgcttaactttcattaagaaggattaaccttgtgagacacccaggcagtgtggtttttcactgtgtgtaaat

SEQ ID NO: 1218 - DNA, 201 bp, Homo sapiens
tgtctttgttccataaacaaccttgtgatatttcttcgaataatatttattcatttatttagagaacagaatccaaaggacagtggagatttagcaccagrggcagtggctgataatctttgataactttggggttgtgagaccactggcagtgctctcaggatatcctctcccaatccaaaatgtactgagtgacacatc

SEQ ID NO: 1219 - DNA, 201 bp, Homo sapiens
gcatcgtggcatttccgagattggagcctaacagtgtagatcctgagaacatcaccgaaatgtgagttcctggagcttttcctcctttttctccttgcccytagggcccgagctggccaggtgggtaggtcctggaagtgaatgctgtcccaagagtggggagaagtcaaagacaagggatgcaggacagggtcatctgtc

SEQ ID NO: 1220 - DNA, 201 bp, Homo sapiens
ggccattcttgggttttctagactaatgcgaaagttttcaccgtgttccaaatttttcctgtgggtacatcttcctatctgagatgcctgtgagaacatayctaaccattccccttggaacataaaaggatgactctcactgtgaaataaggtgagaaacatttctttctgcctgctcattcatggggcctgagaatctct

SEQ ID NO: 1221 - DNA, 201 bp, Homo sapiens
gtcaaatggggattataataatatctgtaatttaagttggtgtcagaattaaatgagacaacaaatggcttcttgtaagtgctggacgattgttggttatrtaatctatcttgggttcagagaggatcttcatctcattttttctcatgtttcctcagacttaatactcacaatttttaatattttataaacaggaaatta

SEQ ID NO: 1222 - DNA, 201 bp, Homo sapiens
  misc_feature (101)..(101): n is a, c, g, or t
tggaaaatcaagttgagaaatttggagttctaattatgtttttatacaagaatcccctagatttgatgtttatgcataactgggactatctttttaacagntttttgtatgattttccaagccaaaattctctcatttgttcactgggtcacatgacaagttaactgattctgacagcctctttacaataggatgctagaa

SEQ ID NO: 1223 - DNA, 201 bp, Homo sapiens
tgatttttaatcttctcagtagatctttcatagaacagacatttttaattttgatgaggtgtagtttattaattttttcctgtggattatacttttttgcrtcaaatctaagaactctacctagccctaggccccaaacattttcttccatgactttttttttgaaatattctataattttacatttaagtccatgttcca

SEQ ID NO: 1224 - DNA, 201 bp, Homo sapiens
acatagaagaaaggaagagaatttgtctcaattttccaagaaggagcaaatttgggatccagaatacacctaaattactgttcattctgttttctcagacygcctccacttgcctagcctactctttctctttttgggctattttgtccaatctttccccatcactggacagggagtgggtacaaaatgagccaggtggat

SEQ ID NO: 1225 - DNA, 201 bp, Homo sapiens
caaatactggctttctttgtaggctcagactacatattgtcatgtgagatgcattattaatatattgtggatatgcctccaagtcaatctatatgaaactstttttttcttttttttttttttttgagactgagttttgctcttgttgcccaggctggagtacagtggtgcgatctcggctcactgcaacctctgccttct

SEQ ID NO: 1226 - DNA, 201 bp, Homo sapiens
taacgtggattttaaagaacattattcaatgtgtttcctcttcaattacttctgtgtcataatttagctagctgtttgccttcaaatgtggcattggcccygtgggcttgcctagtagttcacatcatattctgtttgttcacttttgtatttgttggctaagttgacttttttagaataaagattctctaacttactaat

SEQ ID NO: 1227 - DNA, 201 bp, Homo sapiens
tgggctggtgggaggaaggtaagtgtggcccctgccccactgtggtccttgtagtggttggttcatagcacaggtctacaagtgtgtgtatctacacatgyatggaccttattttgtgtaatatatatatatgtacattatatatattatatatatattatgtatatatatatgcatatgtataatatatatagggtctcc

SEQ ID NO: 1228 - DNA, 201 bp, Homo sapiens
agttctttctgggcaatactcttctctttgctactctgtcttgtgaactctgcactccttgatttctcttgagctagtctcctcaacttaggtagatggcytctgcctgggttccttctctctgaacgatgaccttcattgtcttatatccattgtcttaactttaatatattttgttcagtgttttggtcatatgattga

SEQ ID NO: 1229 - DNA, 201 bp, Homo sapiens
atgtcactagaagatagaaaattttcagctccattataatcttatgggcccaccatggtatatgtagtctattgtcgatggaagcatcataatgggacacrtgactgtattataatttattgacttgttccactattaatggacattcaggtcctatttttaggtatgggccactgtgtcttctatttattaaattatggt

SEQ ID NO: 1230 - DNA, 201 bp, Homo sapiens
  misc_feature (101)..(101): n is a, c, g, or t
aacaggacaacacgggagcaggtatgggtattgacctagactaccaacatgaactaagaaaataatccggagctgaccacgaaacctcgtcagatggatgncctgcaacttagatttaaggatcacccacatgcccgtgactccagttttctgaggctctgttgaattttctccatatgctcttccttttaggtgttcata

SEQ ID NO: 1231 - DNA, 201 bp, Homo sapiens
catagaattcagtttgatggattcttagctggttagacagtcaccttctatgtaaggatgaattaattagttaagaaatagatgtcagcataggcaacgtytttagttgagtgtctggacctgtcatgttaaatattctttatcactgacttaaatagaagcatgaaaggcaaatatattagacctgcaggtgaaaaaaat

SEQ ID NO: 1232 - DNA, 201 bp, Homo sapiens
tgtaacatcctgaccctacaggacttccagtcattttgaaggcctagcatgcagcatgcaatttgtgagtcgtgggcttccaacacagaagtggtggtagrgtgcagagaatacccactagatctgtgattttgaataacctgtcatgctttagtccttaagttgagtgcctgcccttctgagttgggccactgagctcag

SEQ ID NO: 1233 - DNA, 201 bp, Homo sapiens
gttgctgagcctatgaataaccttgccaccagggccactgtgttcatgagcccatgggcaatgactggggtggccatctgtcagtgctgtcagtcagggcstaataatccttgctgccaggaccactgtgttcatgagcccatggggcaatgacttaggtggctggggaaggaggctgacttttatccaagagtgggtcat

SEQ ID NO: 1234 - DNA, 201 bp, Homo sapiens
  misc_feature (101)..(101): n is a, c, g, or t
ttttataacccatctgtgccattgaggggccgaatttggcccagttggggatttggccaaggaaaaggtatgttactgggtctgttcttcccataattcanttgaatttcttgtttgcaaattctggccattttctgtactgctgggaaagatgattagaagagtatgtgttctggaagctgtggacattctatgctctca

SEQ ID NO: 1235 - DNA, 201 bp, Homo sapiens
gaatggagttacaactgtgcagaaagtgagttttatggaaacaacaaatgcagttttggttttgttgaatttgaggtgctgatgagagacccatgttccayatagttcattggcaaattgaactgtggagcttagaggatcttattagtaccttatctaaaaggtcccattatatgtgatttatgggacatcagttaggat

SEQ ID NO: 1236 - DNA, 201 bp, Homo sapiens
ggcttgagtgaatggagttacaactgtgcagaaagtgagttttatggaaacaacaaatgcagttttggttttgttgaatttgaggtgctgatgagagaccsatgttccacatagttcattggcaaattgaactgtggagcttagaggatcttattagtaccttatctaaaaggtcccattatatgtgatttatgggacatc

SEQ ID NO: 1237 - DNA, 201 bp, Homo sapiens
attaaaattctcctctgctgaggtcacttttgggtgagcattcacatggaacacaaatatctttttgactttttttgctcattctgagaattctaagagtyctatccacgtacctctttcccagatttctttatcaccaatttccagtcatgcttcttccaagtccctgactatccagccaaaccactggcttagcccatg

SEQ ID NO: 1238 - DNA, 201 bp, Homo sapiens
ttctatttcaaagaaaattactgagagttctaattacagttattgaaatccaaattctacacagcactctcttcaattatgaacagtgttcataagtaggrtcacttatctagaaaattattaaaaattcaatgtacatgaaagcctcaaaagtccttgaaaggcaaatgttaggaaagggctgtttccatgacaacatct

SEQ ID NO: 1239 - DNA, 201 bp, Homo sapiens
gaataaccttgccaccagggccactgtgttcatgagcccatgggcaatgactggggtggccatctgtcagtgctgtcagtcagggcctaataatccttgcygccaggaccactgtgttcatgagcccatggggcaatgacttaggtggctggggaaggaggctgacttttatccaagagtgggtcattttatccatctgat

SEQ ID NO: 1240 - DNA, 201 bp, Homo sapiens
ctcctctgctgaggtcacttttgggtgagcattcacatggaacacaaatatctttttgactttttttgctcattctgagaattctaagagtcctatccacrtacctctttcccagatttctttatcaccaatttccagtcatgcttcttccaagtccctgactatccagccaaaccactggcttagcccatgacttggtgt

SEQ ID NO: 1241 - DNA, 201 bp, Homo sapiens
aactaaaattgatacataaaattttaaaaatacaaacatataaaatgcaaatatatatataattttggagatgcttgctattaactttcgaacataaccayccctactattagtcatggttattagcaatagagaaaacataattcagtctccctagtttaggcaaaagtgatatttgatgaatctatctagtttatagta

SEQ ID NO: 1242 - DNA, 201 bp, Homo sapiens
aggagggtagaagtaaagggaatataggacaaacattcatacaaaaagctgaaatataaaaatttaatcaaaatcaaaatctgaaatacaaaaatttaccrtaaaaactgatctgggaatgatagttgatataggctttaaaaatatattgggttgtttaggttataaaaaaatacatattaattgtagaagacattgaaa

SEQ ID NO: 1243 - DNA, 201 bp, Homo sapiens
tcctattggacagagagaaactttaattagctgcctccaaatggagtttgcctccaaatggccattcttgggttttctagactaatgcgaaagttttcacygtgttccaaatttttcctgtgggtacatcttcctatctgagatgcctgtgagaacatacctaaccattccccttggaacataaaaggatgactctcactg

SEQ ID NO: 1244 - DNA, 201 bp, Homo sapiens
gactatgttgtacagaatgcatgatgagaaagaagtattagtagatatcagtaacagtctgtcttttaaacaatgttgatataaaaacttattttgctcaktttcagtccaattatttgcccccctaatttgccacagcctagttattttaaaattaattaatctgaactttttttttcttccatgtaccatattgattag

SEQ ID NO: 1245 - DNA, 201 bp, Homo sapiens
ttttccaacaatggtaccactttttatgggcccctgaaaaacagtgtcactgcaatacttgaaacaaatacttgataatacttgaaatatagcacctttcyactgaggaagttaaacaactttgcaggaattatctcatgatctacatgtgatgctaatgaggtaggtggcaaatatgatcagccccactttatagacgga

SEQ ID NO: 1246 - DNA, 201 bp, Homo sapiens
gtgttaaaaaatgaaatgctggaaatttccttctgggggatttttccacatgggctagactagttgaggtgtcctataatgcagtctaatatagaggttgracaatgtgtggtgctagtctgggttttcagtgaagcaggtgctgggacagagtcatgagtgcagaaggcttatgggctgtcacacctgtgaagggcggaa

SEQ ID NO: 1247 - DNA, 201 bp, Homo sapiens
agtctgagattgattgcattaaaaaataatttcagcaaaagtctgtatcatcacctttgtgcttgaagagcagcaagtgatacaaccccaagccactaacrtatatggcaagaaggagaagcagaagaaaaccagggaaaagaaaaagcagatactcattgccctaagaaaaataattttgtaatcacaaaattaaattac

SEQ ID NO: 1248 - DNA, 201 bp, Homo sapiens
tttcaaatgtctaagaaaaaaacaaattatctgagaacaaaagatctggattgaagcccctgctctataaagtagaggctgtatgggcttgaggaaatcayaaccacttaagcttagtgcctttgattataaaatggggaaaatgacatttatataaggttacagggatcaaattatataacatacagaagccatctgtgc

SEQ ID NO: 1249 - DNA, 201 bp, Homo sapiens
cagaaaacaagcacatcagtacttgtcagtgacctggaaagttgaatgggggaaaaaaaagaataaatgatggtcatcagaatgtggcctaaagaaagcayagttttcaaccaagtatcacttgattggatttcacctttttgtttcctgatccacatgctttactggactcattctcattagcgaagaggggaccaggaa

SEQ ID NO: 1250 - DNA, 201 bp, Homo sapiens
gagttcatccttaaaggaaatgacattgaacttgtttcaaattcagctgctttgactcagcaaaccacaacagctaaaaaccaggatatcagaacattttrgatggtatctatgtctctgaaaaagggacagttcagcaggctgatgagtaaaatctaagagttgtacagctacagaaacaagatgtcagataattcctaa

SEQ ID NO: 1251 - DNA, 201 bp, Homo sapiens
gagtgcttatttttctaaaaagtgtgacaagttcctgaaattagaaatgaaaagatcttaaaatacctaatttaatccctgaagccaatgactatcaaaamctctatggatgtatatgtgtgcaatatatagttgctttttcttgagtactgttatatactttgtaaaaccttaaaaccaaaaatatgtcttttaaaatag

SEQ ID NO: 1252 - DNA, 201 bp, Homo sapiens; identical to SEQ ID NO: 576

SEQ ID NO: 1253 - DNA, 201 bp, Homo sapiens; identical to SEQ ID NO: 577

SEQ ID NO: 1254 - DNA, 201 bp, Homo sapiens
tttgtgtttaaactttcaaccaatcattttagcatccatcactggatcttacccataggaaattaccactgttctgatggtgatttttctatttctctaayttcatttacacttattaattaaaactcttctgtaagggagagagattacttcttccaaatttgttcatgtattaagttatttatttatatcactatggac

SEQ ID NO: 1255 - DNA, 201 bp, Homo sapiens
gtcctaaatcagacaagggaaggccctcagagaaggcctgactgcatgaatgcagattttctctacagttgcaaatcccctccacaaaagacagctttacrgggttacttcagttttgctggctctctgaacacccatctcaaaatatgtcaagaaagtatatcttagggtaaaatgttttgatttccttcaaggtgaaat

SEQ ID NO: 1256 - DNA, 201 bp, Homo sapiens
tgctttgggtaatatgaacactttaacaataatttttccaatccatgaacatggaatatcttcctatttatttgtgtcttcttcaatttctttcatcaacrttttatcattttcagtctatgaatttttcatgtccttggttaaatttattcctaagtatttacttttttgtaaatattataaatgggattattttcttga

SEQ ID NO: 1257 - DNA, 201 bp, Homo sapiens; identical to SEQ ID NO: 578

SEQ ID NO: 1258 - DNA, 201 bp, Homo sapiens
catgcaccttttaggaagataaaattcaaagggaattgattcatcaacaaaattagatatcatgctaataagtgaaaagaaagatgcattgagaatatacrctacagaaattcagtagagaagaaaaagattacgaattggtccaatattacataatgcagtaaataaaaattgaacagactcatgaaggaataaactttg

SEQ ID NO: 1259 - DNA, 201 bp, Homo sapiens
tcgatctcctgaccttgtgatctgcccacctcggcctcccaaagtgctgggattacaggcatgagccaccgcgcccggctgtgtgtttctacttctttccycacttaattctgaattcaaatccccggtgaaatgtctaaatcatattctttacctttattgcaataaagtctgagaaatatccttttagttttttagctt

SEQ ID NO: 1260 - DNA, 201 bp, Homo sapiens
agaattactgaatcatatgatatctgtttaatttggaaggaaattaccagttttccacagcagttgtgcaattttacattcccaccagcaatgcaaaaggrttctaatttgtctatatccttatcaacagttttgttattgcccatcttttctatcataaacattctagtgggtgtgaagtagactgtggttttgagctgc

SEQ ID NO: 1261 - DNA, 201 bp, Homo sapiens
tttaaatcatagctatagagagtttatctagatgttgtgccaacaaattctcatgtacaagttgaatacttcattaaggagaataatgatatccaacattwaccaagtgcttgctatgttaccaggcactattttaaatacataacattaatgaacttaatccttgtaaaaatgttacaaagccagtactattattatccc

SEQ ID NO: 1262 - DNA, 201 bp, Homo sapiens
tattaaatttggttgaatgttttttctgcatctaacaagatgatcatatgatttttgtccataattctgttaatgtggtgtgtcatatttgtagatttgcrtatgctgaaacatccttgcatccacaagataaatcccacttaattgtggtacattattcttttaatgtgctgttgacttcagtttgctagtattttgttg

SEQ ID NO: 1263 - DNA, 201 bp, Homo sapiens
gcagggtacattaagagtaagctttggcagccaggcgcagtgactcatgcctgtaatcccagcgctttgagaggccaaagcaggcagatcttttgaggtcmggactccaagaccagcctggccaacatggtgaaaccctgtctctactaaaaatacaaaaattagccaggcgtggtggtgcactcctgtaatcccagctac

SEQ ID NO: 1264 - DNA, 201 bp, Homo sapiens
cagtgcaagactccgtctcaaaaaaaaaaaaaaaagaatgaagtgaaattttaataaatggtgttgaaacaattgcattttcttacagaaaaaaagtagayacattcctgatatggtttggctatgtcctcaccctaatctcaccttgaacaatagttcttataatccccacgtgttgtgggtgggaggtaattgaattat

SEQ ID NO: 1265 - DNA, 201 bp, Homo sapiens
atagcctctacagcccagagcccaccaaaattattgaaactagccaatcctaactctgcttaccctgccttgccatgtgtttcccacagaaaccataatgraagccttatgcccatgctttccccttgctccttctgacttctgatcaattcaggtgcttcactgcatggcccctgtgtggcatgatgtggcatgcacccc

SEQ ID NO: 1266 - DNA, 201 bp, Homo sapiens
atggaagccttatgcccatgctttccccttgctccttctgacttctgatcaattcaggtgcttcactgcatggcccctgtgtggcatgatgtggcatgcamccctcccttggaaactgtgagtaaccaactatcctttcaatagcaaccatatcctgacacacttgaataaaaacaaaaccctgggtatattttaaaacat

SEQ ID NO: 1267 - DNA, 201 bp, Homo sapiens
cctggattcatgaagcaaatctaaatggtttctgactgtctgcaagtttattaacatttaatgattctatacctctaagtttgctggaagtatttactccytttctttctctgtgtattaaccatattttcttattttatgtattcttgatgctctggcatctgacacattgctgattctgtagagtctgcccctcccagg

SEQ ID NO: 1268 - DNA, 201 bp, Homo sapiens; identical to SEQ ID NO: 1027

SEQ ID NO: 1269 - DNA, 201 bp, Homo sapiens; identical to SEQ ID NO: 1028

SEQ ID NO: 1270 - DNA, 201 bp, Homo sapiens
gggggctcgccgacactgtggaaggcagcttccctggggcctatgactgcagggggccaagccagagtggactttgagctggtgatgggctggtggcgctrtgagcttgggacccagccaggcacagcagtttcctggcccgcgctgactctgctcatgctttcctcctcagagccaaccaaacacctgctcaggcaactc

SEQ ID NO: 1271 - DNA, 201 bp, Homo sapiens; identical to SEQ ID NO: 548

SEQ ID NO: 1272 - DNA, 201 bp, Homo sapiens; identical to SEQ ID NO: 549

SEQ ID NO: 1273 - DNA, 201 bp, Homo sapiens
agggagtcagctgtagggcagtcgctccctggccgaagccttcctggctgtttccgtcacaccctgaggccacccctcttatcttgcgaggagggaggcayacagaggctgtgattagctgtcacagtagcaagactgttcccctctctgtcctgcggagtgagtgtgagggaaaagagctctccttgtctgctcattatg

SEQ ID NO: 1274 - DNA, 201 bp, Homo sapiens
gtagtctgaaacagtttccaggaccacttctctcttgtttaaaattcagctttggtcctttgtaatattcccccctccatgagactcaacttcttaggaawgaaccttcctaatggtgtgagatattgacttaaacatgacccaaatacatgattgttctgcaatggcgagtcaatcttcccaaatcttttttatcagctc

SEQ ID NO: 1275 - DNA, 201 bp, Homo sapiens
ttccacttcaggaagttttctcaccatgagactaaaatgtactgtgttgctattgttactattagttctgtttacctgaagagatagtggaagctttgacraaacataggttaagagtagggtggagtctaagctttagtttatcagagctggcttacaagtagattacaaagtgtgctgcagggtaaaatgaggggatag

SEQ ID NO: 1276 - DNA, 201 bp, Homo sapiens
atttcctttgtgttttgttgtcagagtagaaagtgtaggaatataatgataaaggatcaatagagatgaaattgcttataaaaatcaatagctttaatggytttaaatatttcaggacattagcatttgacacaaacaacattgaaagaaaccttatttaatggacgtttctggctcaattctcagtctctttaatttgtg

SEQ ID NO: 1277 - DNA, 201 bp, Homo sapiens
tacatatacagtgctatctcttgtttttattgtcatacacactcacacacaactcatacatacattcattttggagataaaattataactttgagaaaggmgttaacatgttattctctaggaagctaggaataaaaagtagttgaccaataatatgtctttctatagaaatactaagtaaagatttgtattaacctcttt

SEQ ID NO: 1278 - DNA, 201 bp, Homo sapiens
ttctatagaattaaataaaatcagtgaatttgtattgaagaataaacaaaacacattgtctattatttgaaatagacttcccatatttaaagttttataaratatacagcattgaagcctggccttactacgaaaaatacttttgttggaaaatctattgaatagttaaaagaagttttagttttccagaacatatttcac

SEQ ID NO: 1279 - DNA, 201 bp, Homo sapiens
tgagggagatatgctgaggtgaactgagcaagcatgtttccacggttgatttattaccttggatctaaagttatattttttgtatctgactacacagttartaacagtttttcatttcttattctgtatatctctattatgcaacctactgctagatctgttactttttacaaaaaaaatagctggtatctattaagtatg

SEQ ID NO: 1280 - DNA, 201 bp, Homo sapiens
agactatttgaaccttttcagatttagaagcagtcttttaccaagtactttcttatacattgaaagtcaatgagtgttcagggattagctagatgcaaagmctaattcagaagtgaaggaatcattacatataaattaatacaatttgataacactatctatctttctacctctgtttctttttcttttccatatgtcttc

SEQ ID NO: 1281 - DNA, 201 bp, Homo sapiens
tttgctgagaattcttagccattgctggagtgaatgtagctaagagtagaactaggattactgtaatagttactctgttgaagtgatctagaaaatgagaygtgttgaagcggggaagtgtttgattgtcaggtctagaggaaaagaataggaaaagtctccgagctttgaatttcctgatgtttacatagtacaaaggtt

SEQ ID NO: 1282 - DNA, 201 bp, Homo sapiens
agtgagaaaaaaatcacttcctaatgagctctttaatccttgaagaaaacattaaatctctattctggcggagctaattttcagaaactgtgaaatatggsaagtggttaataagtgattgctccagggcatgaaataaggacctggaggtgttaactgcttctagaaatgtttactatttctgttaaggaggattgaagt

SEQ ID NO: 1283 - DNA, 201 bp, Homo sapiens
ccacttgtatcccaaaaactattgaaataaaaagataaaaggaaaaaataaataaatgaaggtcaataaataaacgaaggccaatagcataatttggcaaygtatcaaatgaaaccttgtacagtttcagggcaacacattcctaattctgatcctttttctctgcacaaatcagtctcagtttgtaacactttcttcaag

SEQ ID NO: 1284 - DNA, 201 bp, Homo sapiens
agacactctgtgagggactaagagcacagaaaacccaactgtggaccagtttggccgaaataatcaaattgtgtagaagtgatgtaattggcccagaacaygcaaatggtaaaaactgggaccagaagaacccatgtctgactaatgccagaatgtcttactgcctgcacataagagttgctaagggaggattcgagatca

SEQ ID NO: 1285 - DNA, 201 bp, Homo sapiens
tcttcatccttctaaggtatcaattcagtagccctaagagcacattcccaagagctatgaaaccacctgaatctggaggcttaattatcctaggctgacamactcaggagacctaaagatattgagaaaagaggcatgcaaatttctctaacctatttctttaggaaaactatctgctaacaaggtaacaaaggcttaccc

SEQ ID NO: 1286 - DNA, 201 bp, Homo sapiens
ttatataggtttaactgagcttcttaaatatatataaaactcatccaaatatctgtccttaaaatacaaaaacaaataaacaaaagacaaacaatgaaaaygcaccaaccctaataatagtataaggaagaacactattaaggaatcagtgacattagcctcttcccaatcgatttctccagaagataaatgcttttgcca

SEQ ID NO: 1287 - DNA, 201 bp, Homo sapiens
actaaagtacaggaattttaccctcagagagccactatgtctttctcatccccagtaagaactttctttattccccactttttctcctatgaattgacatkccaacatcagtacacaactgttaaagctttagattgctacttacttttgaatctaatttttgttttacgtatgcaccatttgctgctgttaggacatcgt

SEQ ID NO: 1288 - DNA, 201 bp, Homo sapiens
ttaccctcagagagccactatgtctttctcatccccagtaagaactttctttattccccactttttctcctatgaattgacatgccaacatcagtacacamctgttaaagctttagattgctacttacttttgaatctaatttttgttttacgtatgcaccatttgctgctgttaggacatcgtttatcagaataaaagca

SEQ ID NO: 1289 - DNA, 201 bp, Homo sapiens; identical to SEQ ID NO: 1181

SEQ ID NO: 1290 - DNA, 201 bp, Homo sapiens
tttttgaaagtgctcaagtgaactcaggatctgtttccttactccctcagaggggaagggcggttaattaaatggcagcatagttcaataaaaaggacatsggtttgatgtattagcaagtcatctttctctgagttttgttttctcattggtaaaatagggagagtaagacccatatgacacaagatactatcctttact

SEQ ID NO: 1291 - DNA, 201 bp, Homo sapiens
tacttggtccattctctgtggggacctcaaactcacctaggatacgcagcctcctacccgattcactaagtggaaagtagtctggaggagctcacagatcygaccactcctgccctgtcctccctggctcttccactgagactgccacccaggactcccttggattccagccagctggatgcctgacctgggcgccaattc

SEQ ID NO: 1292 - DNA, 201 bp, Homo sapiens
tctctgtggggacctcaaactcacctaggatacgcagcctcctacccgattcactaagtggaaagtagtctggaggagctcacagatccgaccactcctgycctgtcctccctggctcttccactgagactgccacccaggactcccttggattccagccagctggatgcctgacctgggcgccaattcttctgccctggt

SEQ ID NO: 1293 - DNA, 201 bp, Homo sapiens
ctggttagtactaaaaaagtccagtcccatgagggcctacctattctcacagattaacaggtctgtgactggtggtaccccacatatctgtgggttactgragaccatctatgataattagaatctttcactatctgagcttattcctggcaatacattttttgggcgggggcatgggaactttgggaaggctcttctatg

SEQ ID NO: 1294 - DNA, 201 bp, Homo sapiens
aaacgattattactacaagagactacttgtttctttgtgagtttagatttaaaagatgtagtttaaatacttttaaaaatgtctgtatcaaagtacactayacaagcattgcataacctggtttcatagcatttttctttctggggatgtgggattcaatgtaaaagcaaaattctacatttgtaaagctctatatgtttt

SEQ ID NO: 1295 - DNA, 201 bp, Homo sapiens
tgctgaagagaaaaaggaatgctgaccgaaggatttgcaggggattctcaagcacagaaggaagcttaaagcctcttgtaggaggaatggctgagctaaaygggttataactgggatgctaatgacagaagctgcactgtatcctgtgagacttcgaccctgcaagggtatcagcagattcccatctgtctgcatgtgcaa

SEQ ID NO: 1296 - DNA, 201 bp, Homo sapiens
actaatacacctaagccagccagacagaaagctcagagctcacagaccctaaaatgcagttgtgcaccttccataaggacaacatgtcctctgggccagasgaagacaagagagatccttaaatattgaagaaaaccaaattaaaactactttaagaggggatacaggttcacttaacaactaagtggcagcagttggaac

SEQ ID NO: 1297 - DNA, 201 bp, Homo sapiens
aaatgaaagggtacactgatcatctcatctcttgtccaagaggaatggattctcaagtacctagttgtttttgcaataggagtttgataagcaaatgtgasaaacattccacctttttatctctgctaacctgtccagcttcaacttttgctacttccgcataaatctgatggcaccagggctccaacaataccaggctcc

SEQ ID NO: 1298 - DNA, 201 bp, Homo sapiens
tgctggttcatttggttaggtgtatctttaacttcgtaagaaactgccaagctgttttccaaagtagctacacaattttgtattctcaccagcactatatragagctcccactgatctatattctcaccaacacttggaactgttacaggccattctaataagtggttaagtgatattttctcattttaatttgcatttcc

SEQ ID NO: 1299 - DNA, 201 bp, Homo sapiens
gaaaaaaaatttctactcccacccttcatagacttcttgatattgccccacaggtcactaatattgtgttcatttgctttacaatcttttttcctctataygcttcatcttggacagtttccattactgtctttaattcactgatcttttctcctaatctgctgtttcattccttccactttatttttcaattcagatatt

SEQ ID NO: 1300 - DNA, 201 bp, Homo sapiens
agcaagactgtaagttccttgggagcaggaaatgtgtcacatgtcatttctgcagagttccatgcacttagaagtgctaagcacaaatactagtggcagtrgattaaacatccatgatctgtggcccagcatcattttctacacacagatgaggtgaactttgcttttgttttaatccctgaccccctctgaactttgctt

SEQ ID NO: 1301 - DNA, 201 bp, Homo sapiens
aaagacctcaaataaacctctcataaacctaagtttcttctctcctctagctctaaatatctcctctgctttcggtgtacaattctgacatctattaagtmccatgtgccaggccccaggcaggatttgaggcacaatgctaaagatggtttaatcaggcttcctgataatcaagcagcaaatgattaaaaaagtgctgcc

SEQ ID NO: 1302 - DNA, 201 bp, Homo sapiens
agtgcctattatgtaccaggctcagaaacattcagtaacttttccaaaattatctagctagtaagtacctgttcagctccataacctatagtctttccatytgtactgccgcaaaaaaaaacaaaggcaaggcaacaacatgttctcaatttttttttcctttatggctccacgtggttaccaatcagtgagtcaaatagc

SEQ ID NO: 1303 - DNA, 201 bp, Homo sapiens
cttaaacttccaccagttatctcctggtggtagatttgcaagcgaattttttattctccctaagataggaaatagaaggcatggtgaacatacattttgtyaatcaggaaaaaaacaaaacatttaaaatgaaacaaaacttctgcttctagagaaagctctgataaagagccattgtgaagagaatgacctacctggtca

SEQ ID NO: 1304 - DNA, 201 bp, Homo sapiens
cagtcagccagagacatgagtgttatccaggaagtagaggatatgcatggaggcacacatacacacaaatacacatcatccagtaactgacaaacagcaaraacttaaatgccaaaacttctgtttttctttatacattttaattgttttgaatgtctttctccctgccttcttaaagtacactgactgaaactagattta

SEQ ID NO: 1305 - DNA, 201 bp, Homo sapiens
tgcataggtagttgggcccctgggtgaaatttctgaagtgtggatcatggttagttctgagatcaagctagaacaatgtctaagcacatagcaggaactcmaatacttaaacaatagctcaatgaacctgtgaagtataacttgggggtttagggaaactgaaaatttctggaacttagagtaccaggcacgagataagaa

SEQ ID NO: 1306 - DNA, 201 bp, Homo sapiens; identical to SEQ ID NO: 1199

SEQ ID NO: 1307 - DNA, 201 bp, Homo sapiens
cctaaaaaataaaaatgctttcttatttttcctgttaagatgatctttgatgttcacattaatcctatttaaactggataggaatactggggaagcacagratagaagaagacaaagaatgtcctgtaatttattccaggcttagccctaatgataattccagaccctatattcccagcatagtcagtgtattggaaaaaa

SEQ ID NO: 1308 - DNA, 201 bp, Homo sapiens
cctctttatggtacagtttcctttacattctgtgtttactgagctccttgtgtgtgtgcctttaaagttttcatcaaatttgcagaaaaaaaatttctacycccacccttcatagacttcttgatattgccccacaggtcactaatattgtgttcatttgctttacaatcttttttcctctatacgcttcatcttggacag

SEQ ID NO: 1309 - DNA, 201 bp, Homo sapiens
taattcactgatcttttctcctaatctgctgtttcattccttccactttatttttcaattcagatatttttcatccctaaaagttccaattgagtcttttkttatagctttcttttctcttctcatcctttcttaacaatccttcacagcctgtcatccaaagactgaaaaatgttgtttgataaatgtttgattttctag

SEQ ID NO: 1310 - DNA, 201 bp, Homo sapiens
aataaaacctacagatcatgtcaaaactacacattccagcttgccaagtaggtcacttgctcttatttaaaaagagatatctcagaggtaagaatggttaraaacataacagtgtcagtcaaataatatactggcaaagagaaagttctattcattcataactaaagaataattgatccaacccacctgttttacatatgg

SEQ ID NO: 1311 - DNA, 201 bp, Homo sapiens
gaatcactggctttgtactaaaaaaaaaatcccatctggaggtagcaattagtaagtttaaacacaatctgtactgatgctttggaaagtcattggtcaartgatgtccactctgcctttatctatgttaactaggtatcttttattaacagtaagctggtttttgcatgaggcatagtttaaaaaaatgtttttaagtta

SEQ ID NO: 1312 - DNA, 201 bp, Homo sapiens
gacactttttagcaacacaataagtaactgctgaactgagtatcccctatcaccccacttgaggaaagggggcctcatgaacccaattcttacactttttwttgtctttccccccctttctgtggaaaatggggtctcgctatattgcccaggcaggtcgtgaactcctgggctcaagctatcctcccgcctctacctccc

SEQ ID NO: 1313 - DNA, 201 bp, Homo sapiens; identical to SEQ ID NO: 1206

SEQ ID NO: 1314 - DNA, 201 bp, Homo sapiens
tggataaacaaaatggtacacatacaatggaatattattcagacttaagaaggaaggaaattctgacatatgttacacaacatggaataacatcaagggcrttatgctatgtgaaataagccagccacaaaaagacaaatatggtacgattccacttatataaaatacctagtgtagtcaaattcatagaaacataaagaa

SEQ ID NO: 1315 - DNA, 201 bp, Homo sapiens
ggagccctagctttgcataaatcatacgagccccaatttccttccagttcactgtcatttgcccaagtcagccagtatctttctgttgatggtaaccaagracccttacgcccaaccatccaattagaggagggctccattccagggcagggcaggcttacccagctgctaggctaagcacacacttcaagcatcagcaag

SEQ ID NO: 1316 - DNA, 201 bp, Homo sapiens; identical to SEQ ID NO: 553

SEQ ID NO: 1317 - DNA, 201 bp, Homo sapiens; identical to SEQ ID NO: 555

SEQ ID NO: 1318 - DNA, 201 bp, Homo sapiens; identical to SEQ ID NO: 557

SEQ ID NO: 1319 - DNA, 201 bp, Homo sapiens; identical to SEQ ID NO: 558

SEQ ID NO: 1320 - DNA, 201 bp, Homo sapiens; identical to SEQ ID NO: 559

SEQ ID NO: 1321 - DNA, 201 bp, Homo sapiens; identical to SEQ ID NO: 560

SEQ ID NO: 1322 - DNA, 201 bp, Homo sapiens; identical to SEQ ID NO: 1028

SEQ ID NO: 1323 - DNA, 201 bp, Homo sapiens; identical to SEQ ID NO: 736

SEQ ID NO: 1324 - DNA, 201 bp, Homo sapiens; identical to SEQ ID NO: 737

SEQ ID NO: 1325 - DNA, 201 bp, Homo sapiens; identical to SEQ ID NO: 738

SEQ ID NO: 1326 - DNA, 201 bp, Homo sapiens; identical to SEQ ID NO: 739

SEQ ID NO: 1327 - DNA, 201 bp, Homo sapiens; identical to SEQ ID NO: 740

SEQ ID NO: 1328 - DNA, 201 bp, Homo sapiens; identical to SEQ ID NO: 741

SEQ ID NO: 1329 - DNA, 201 bp, Homo sapiens; identical to SEQ ID NO: 742

SEQ ID NO: 1330 - DNA, 201 bp, Homo sapiens
tcacgttccagtccatattcacattcttttggccaatgtttatctgcttttgccacctgctcttaatcctgtggtatatggagttaagaccaaacagatcmgtaaaagagttgtcagggtgtttcaaagtgggcaggaaatgggcatcaaggcatctgagtgaccctggagtatagagggacttaatccaaaataaaaaaa

SEQ ID NO: 1331 - DNA, 201 bp, Homo sapiens
tattttatcttttgataacccattttttgttagcatgagagtaggcgtagatacctaatatgccacattagtggttcacaccttatccttaaagctccttrtcacaaaccttcccatcttgttcctttgaagtcattgaatacctgagcaaactattagtcactacccatgcattgatgaggatctaacaataagatattt

SEQ ID NO: 1332 - DNA, 201 bp, Homo sapiens
tgtggataagatattgggaacttctgaaaaattttagtagggctatgcctagagaattttcatgatcttaacaaatcttgctcattcagcaagtccttagrgagccttcatgggaacctatgaaaaagaaagtcctcaatgtattacatggaaaataacgatagcaacaactataataataatagtggctgcatttaaagg

SEQ ID NO: 1333 - DNA, 201 bp, Homo sapiens
aagaaaaatacagacaaatatccccaatgaacatacatgcaaaaatgttcaacacaatactagctaaccaaatccagtagcctatcaaaaaaataatacamcatgttgaagtgggtttcatcccagggatgcagagatggtttaacatatgcaagtcaataaatgtgatacaccacataaacagaattaaaaacaacaatc

SEQ ID NO: 1334 - DNA, 201 bp, Homo sapiens
gggggattgtgagcagctagtcaatggatctggggttggtgtccaccataccacactccaagtcctcctagtttctgctttcctcagtcagttaatctgcragctaccttgcttctcatcctctcttctgtgagaggtcaggcaccatgttctggcagttttcccaaacattcctctacattcttagccccactggtctcc

SEQ ID NO: 1335 - DNA, 201 bp, Homo sapiens
gagggtgtgtcgctagccctgctgcatgtggtgtggtgcagggtgccagtgcctggtgggaccagagagctcccagcacagcctttgggcaggtgggaccrccgatcattttaaaataattttttattgatttaacttatattttgagttcaggcatacatgtgcaggtttattatataggtaaacttgtatcatggggtt

SEQ ID NO: 1336 - DNA, 201 bp, Homo sapiens
ggaactggctgtcccacaccactctgacatttccagagaagcaccgtcctcttccagtaggacatgagtaagaccagtgaggagccaacatgcagcccctsggcatctctggggttgaaggaaagatatatatgtccttctgatgtgtggagccctgagggcagtgttcaagaccctgcattttccgaagtacttgtttac

SEQ ID NO: 1337 - DNA, 201 bp, Homo sapiens
ttttaatttgctgatttcaagagcggtaagtgaatacatatgttttatattaagtcaccaaatttgtggtaatttgttataacagccataggaaactaatrtactactttggtagtctggaagacaacccttccaaggatatccatgtcaaatccttggaacatgtaactattactttatatgacaaaagagtgaatatta

SEQ ID NO: 1338 - DNA, 201 bp, Homo sapiens
tacccgtttcagcccagtggaatttaaccagaactgtgggattgaaactgtctcttgaagaggaactgtggggaaaatgaacaaaccaacattcaggctcmgttggagtatgcttttaggctttcccaggttatggagtataaagctaattgttgattcattccttcttggctttacagttgtagaaagagatctggccta

SEQ ID NO: 1339 - DNA, 201 bp, Homo sapiens
agagaaatggaatgttgcgtgaaatgtcattccaagaagagagcagatttcctttaggctagtctgatggataaaaggaagaataatttcagattttcctraaaagaggaggttgcctttgcctcattcattccatttgttagcctttagagcagtggtatctaaccctttcaatatgaggactctctttgcttatctgtg

SEQ ID NO: 1340 - DNA, 201 bp, Homo sapiens
acacagatgcaaatgagatgttctgggagaaagcagaaaaagcccttttcacagagttccttattttactattctattacacttgtctgaggttacaatcwcatccttttttaacaatctctaaatgagaaaatcatcaaaagggtatgtagtgagtgacagacacaggataaatgctgtaagtcagtgtttgatgaaaga

SEQ ID NO: 1341 - DNA, 201 bp, Homo sapiens
aggccccagtgtgtgcagttcccttctatatgtccatgtgttctcatcatttagctcccacttataagtgagaacatgtggtattcggttttcttttcccrcattaatttgctaaggataatggcctccagctccatccatgttccgcaaaggacaagaactcattcttttttatggccacatagtattccatgatgtata

SEQ ID NO: 1342 - DNA, 201 bp, Homo sapiens
ttccagtaggacatgagtaagaccagtgaggagccaacatgcagcccctgggcatctctggggttgaaggaaagatatatatgtccttctgatgtgtggakccctgagggcagtgttcaagaccctgcattttccgaagtacttgtttactgagcaagtgtttctgcttgttgcattatgtcaggggatatggaagccact

SEQ ID NO: 1343 - DNA, 201 bp, Homo sapiens
acccttcagcccaaggccacctggagcacatctgtgggtgaagaagttgggtttattactcactgcagtgggagggagaatgcacaccttggataactacygagtatcttggtaagtgccttttagatagagcctattataatatttgggcttcagctggtatttcaagtttccctgggatttaattaattagtagttatg

SEQ ID NO: 1344 - DNA, 201 bp, Homo sapiens
tcagtcctgggcagatgggaaggttcatcccctgccctgcagcaagagggccccgtccaggaggcacccacagcaggggcagtgcaggtttgtggtcgctsctgctttcacctgcactgtctcctatagaggggttgtcacttctgggtccccgtgggcaggaaagtttgccttgtaggtcacggggcattggccagggaa

SEQ ID NO: 1345 - DNA, 201 bp, Homo sapiens
gaacttctgtttccttcagggtgacagagggtcatattgttctctgcagagctccaatgcatccccatcttcaatcccgccaggccaaaagcaatccctawgataagtctgggtctttgtggctgatgtttgtaaactgtgttgaacctgtaatgaggccttcatttccctttaggctttggttaaaagtgtgtcacaatt

SEQ ID NO: 1346 - DNA, 201 bp, Homo sapiens
aattgttgattcattccttcttggctttacagttgtagaaagagatctggcctaaaatccctataactgggacaggctgagtccaggctctgacattggcyagctgtgcgactgggcaatattttgtttcactctctagcctcattttcaataggtaatacatgcaagtagcaggaaattcagaaagtatgcaaatagata

SEQ ID NO: 1347 - DNA, 201 bp, Homo sapiens
ccgagaagcaaggagtatgtctcccagaatccccttccctgtgtagttccgattcacattttccaatcagagaaacttgcatgagatatggtgcccagaaragatggagagacaggcctctacccatcagtcgtggctgcaggcagaagagtaggcagatgtcaggttctcagtggcttctgtgctaggccaaagacccat

SEQ ID NO: 1348 - DNA, 201 bp, Homo sapiens
ctattttgtgctattattaataatgcagccgtaagcatttgcgtataggtgtttgtgtggacagatgtttttgtttctcttgggtatgctgtatacctagraggggatagctgggtcatatgctaacttagtgtttgacattttgaggaagtgctggcctgttttctaaaggggcttcacctctttatattcccaccagca

SEQ ID NO: 1349 - DNA, 201 bp, Homo sapiens
ggagaaggtaagtaagagacttatctccattcccttcatatctaattaccaaatcttccatctagctcagtcaggttgagttgaaaacatcttgactttaktcatttagccactgagcacatcatagctcttttcatacctcagtcttattcaaatatttaatttatcaagctcacttataaatgccaagcctctcatttg

SEQ ID NO: 1350 - DNA, 201 bp, Homo sapiens
cagttaacaatgaaatcaagatggaaatttaaaaattctctgaaatgaatgataatagtgtcacaagtaatcaaaatctctgggatatagccaaagcagtraaaataagaaagttcatagcaataagtgctgacttaaaaaagcctgaaagagcccgggcacagtggcttatgcctgtaatcccagcactttgagaggctg

SEQ ID NO: 1351 - DNA, 201 bp, Homo sapiens
agtactcagctcagcacgcttctggtctctggttcagccttctctcccacctaggcctatggagctactccatctcaggcttctgctcttgtctggggtgygaatcgtagtgtgtggccacttccccagctcagatcatcattgcctgtccctgggatttctgccaaaatttcccaacacatttctttgccttcagtcttg

SEQ ID NO: 1352 - DNA, 201 bp, Homo sapiens
cattgaggaagtatctgctctacccttgcttcagattaaacattttgaaactctcagttttaacattattgagccttactattattgaaataattcttttyccaaaacaccagactacactcaaactccagaagatgcccctaaccaagactaatattctgacatcaaaggaaatctgtggataagatattgggaacttct

SEQ ID NO: 1353 - DNA, 201 bp, Homo sapiens
agtttataacttatctttcttgaaggtaatctcagagtacctatgaaaagacatctataaaatacttttgcaaaaatacctaatacatcaaatgtgtgctyaccacatctcatcaaagcaaagtgtaaaacgttctcagggacctgtagagctaaaatgtcaccttctatgttcaagatatatgttgaattctatgtccga

SEQ ID NO: 1354 - DNA, 201 bp, Homo sapiens
gtcaattaggtgtctgagagaagatctcctggcttcaatccagcttcaccacctcctcaacctctctgagtcacatagtagattcctgatgggttttctcygatgattaaattatatattgtctatgtattatacacattattactgactgagacatattaagtgtccacaattcatagctaacatcatattgattatact

SEQ ID NO: 1355 - DNA, 201 bp, Homo sapiens
gaataatcaccagcgtgtctggaaagagtgagacactctggagactcaagggacagtgttggcgatttattggaggtttgcagtgtcacaataggagggtktttcaataggaggaaaacatggtccaattgaagaaagggccagaaggaagaaaagaggaagatgggctccagtgctagaaaagagagaccaaatacagtc

SEQ ID NO: 1356 - DNA, 201 bp, Homo sapiens
atctgagtttctcttcctaaaatcctttccttcttagagcgatcaatgagccctgttgaatggcctatggaagggaaatgaatgttctaaatttcctctgwcccttttcttcggacccccaaaggcattccccaccagcacccactatgaccccatctctgactgtaataccaccctgaggtgctgggccctgggcttcca

SEQ ID NO: 1357 - DNA, 201 bp, Homo sapiens
ctgcgcctttgctcattctgaacttcttgtcaattctcaagtgtcagcagccacctctagttgcaacagagtggactttgcttaatcttattgccctctcmacctctctagggcattctataggtagaatcctcctttttgtggtccctaagttggcctggatattacactctaaagtctagaatgcagtcatgccaaatc

SEQ ID NO: 1358 - DNA, 201 bp, Homo sapiens
tttttacatttttcttattgccatgtaatttggggcagagagtctttgcctaagcatgaacttattgtgccatcctgaccaaagcctgtcatttagggatrtgtcctgctttgtggtgggtcattctgaaattacccgtttcagcccagtggaatttaaccagaactgtgggattgaaactgtctcttgaagaggaactgt

SEQ ID NO: 1359 - DNA, 201 bp, Homo sapiens
tacagacccagtagacacatttcaaaaattataaaataattaaaccttacaatcccatcgcattagtaatctttacttttccacaacttgaaacaattctrtgtccttcaactctcggacccctttcctcatcgtctcttcctaggtcaaatatgtatgaagttttcacaactctggagtgcagatgttctaagcatgacc

SEQ ID NO: 1360 - DNA, 201 bp, Homo sapiens
aaattacttgtcatgaattaagtattaagagggatttaagagatgaagaacagacagaatatcttacatctggtgagctgagagagttcgtgcctcttggkctcctttttttgttaaagcagcaaaggaggctttctgctgagaaggcagggatgggagtttcttagaggacttgaagagaggagaatatggaagattcac

SEQ ID NO: 1361 - DNA, 201 bp, Homo sapiens
ttcaataggtaatacatgcaagtagcaggaaattcagaaagtatgcaaatagataggggaattaattttccagctacccattttatcttccagaggagaayacggtaaaaatattctggatatttttgtaaatatatataaacaagttggtattgatttaaatttttctttcatacaaatggtagaatactattctatggg

SEQ ID NO: 1362 - DNA, 201 bp, Homo sapiens
ataaagcaggtaaacaggtgaccaattggagtcccaaaagaagatagacacaggatcagaaaaaaaattcaaaaaaatctatggctgaaagattcccaaayttgatgaagaattttagcttatagatgtaagacactcatcaaagctgaatacccacatagaaaatcataggtagagtggccatggccttggctggcctga

SEQ ID NO: 1363 - DNA, 201 bp, Homo sapiens
aattaagagagaaagctacacatataaacaattgatggacttgattgattaacatggaaaagcattaactttccagttttctgcctctcactggaattttrtccctacactttgaactcatttcaaacttctggcttaactaggaattgctatagtcaggctattctagacagctcctgtgagccactaggattcagagaa

SEQ ID NO: 1364 - DNA, 201 bp, Homo sapiens
actacattgtctcagtctatctttctgttcagtcagttaattattaggataagaagataccatcaatctgatttttcccccatatttttaaaggagaggaragagaacaatttggaaggtcaagaagttggtatgcccaggagctcacaactctcacctttggggttttatggaatatttttaggccttatttatttatta

SEQ ID NO: 1365 - DNA, 201 bp, Homo sapiens
agtgctcattttgcttatggaataattttaggaaattttaagtgtggttgatgacatcttcctccagagaggatttgtgtttgttttgcgtgttatttgcrtttgttttttgacaggttccttggagcctggcccactataaactgaattcacaacttgatgattgccagacaatccaggtagtgagaacttgggctgcaa

SEQ ID NO: 1366 - DNA, 201 bp, Homo sapiens
gaacatgtttccacgtgcttattggccttttgtatattttcactggagaactgtaaatccaaatcctttatttttaaatttgattatttgcctttttactrttgagttataaccggttttatatattatagacaaaattttctcttttaccatatgtatgatttgcaaaaattttctcccattctgtggggtttttttttt

SEQ ID NO: 1367 - DNA, 201 bp, Homo sapiens
aggcaaaattatgtatctcaaatttaaaagttgatacctgtttgcaagaaactcattaaatgccaaagaagtacttgattcaaacaagttccttgaattcraaatcaattatttgtatctaaaagtataaattgcgttctatctgcatcaccatatgttaacaagacaatgcaaagctcaaaatgtaattttgtattattt

SEQ ID NO: 1368 - DNA, 201 bp, Homo sapiens
taaaggcgatatatgagcagcccatcactaacatcatattcaaggagaaagaatgaggaaggctttttctctaccatcagaaacaagacaaatatacctaytcaccacatctgttcaacttagtattggaagttctagccagagtaactaggcaagaaaaataaagtaaaacacccaaaatggaaaggaagaagtagaatt

SEQ ID NO: 1369 - DNA, 201 bp, Homo sapiens
gacctgtgtccttggggatcctccagtggccctagttgctcctgctggggatgacctcaactcctgaatccaaccctgtaaaataagaagaaattcagacrttgcaaggcatgaaaaattttctcccaatagcaaaggtgaaggatgtactcggagaggagggaacataccaagaagagaaggaaggaatatatattgaaa

SEQ ID NO: 1370 - DNA, 201 bp, Homo sapiens
tcaaactttaaagaattaacttagttttatttggaaatcttactgaggactatagacggaggcctacaacccaagaacagccctttagagaggctctatcrgactgtaccagctcagtatttcagcccactgcttatattataggtgttctgtattgcaacatcacatcacacttggtaagaagttacattaaagcagaat

SEQ ID NO: 1371 - DNA, 201 bp, Homo sapiens
agaaaattaggttcagaaagtttaagtaacttgcccagggtaacacaattatgaagatttgaggccagaattcagttccaggcagttttgttctagatctrttgctcttcagccactatagtgtcatgccaagactggcctaaagtcgtgtcttctgctcaaacaggtccttctatggcaatgaccatgaaatacatggct

SEQ ID NO: 1372 - DNA, 201 bp, Homo sapiens; identical to SEQ ID NO: 1330

SEQ ID NO: 1373 - DNA, 201 bp, Homo sapiens
aacattagcaacaaagtcatccaagaagtcatctctgagaacctcaagtccacgctgaaacaggaagtgaattttctcctggtgggccttttgaaataaaygctccatcttaaaaatgccaggacccttcttaatagctatcatagaagttatacctccgatcaaatcaaccatttacaaaaagaatgatgacaggtgcct

SEQ ID NO: 1374 - DNA, 201 bp, Homo sapiens
cttacctaagcacaatataaggtcacttttcagataacaaaaagaaactatcacatcatctgtgcattattcagttaatctagcagatttgtatcagaacygaaatagcatatactatggggaaaaaagattgcaaagaggacctaaaatccttttttccttttgcaagaaacttcttttcatttttgatacaagatttca

SEQ ID NO: 1375 - DNA, 201 bp, Homo sapiens; identical to SEQ ID NO: 639

SEQ ID NO: 1376 - DNA, 201 bp, Homo sapiens
ggtcatgctactcatactaaggtactcatttcagcaagtatataatattgtaaagaatcctaagatgcttaattttgtaagtttgcattttactcggatcrtatttagcaagcagcagctatatttttcactgctcatcatgcaccacccttctcctacttgataactcaaaccattgaaatacagatgtagagtactaac

SEQ ID NO: 1377 - DNA, 201 bp, Homo sapiens; identical to SEQ ID NO: 718

SEQ ID NO: 1378 - DNA, 201 bp, Homo sapiens
cagctcagactaaaattccagctctgagactgaaatcttacacatgataaaaattgccagaagcatgtgaatttataacctgccaatacagccctgtctgrtggagaaacaaccccactagctacattgtaacaatgccacggatagacttggggttcaggtagaagggctggacaatgccatgaatagacttggggttca

SEQ ID NO: 1379 - DNA, 201 bp, Homo sapiens
tttagttttggacactatgggaaaccttcaggtgccctttcttagtgtaattgtttattctttttaaagaactgtgctaacattattgctacttagcaatwgtttttaatctggtgaaaataacaggtcagtgggcagtgaaagttctcctgtcacacttgtcttctcacccataaaaatcacttaaagctctgaagccag

SEQ ID NO: 1380 - DNA, 201 bp, Homo sapiens
gggtgagagggtctcttttcccttggagacactgaataaactacatgttgtggcctgcattttgactgcagcccatcacatgaggtcaggtgtggaacttkccatttgtactgccatgttggtactcaaaaagtttcaaattctggagcattttcgattttgaattttcagattaggaatgcttaacgtgtgttttgctta

SEQ ID NO: 1381 - DNA, 201 bp, Homo sapiens
gtgcttgcgtgggggagtcggggcatgtgcagaaaaggcatgtcacagctgaaggagggtgagagggtctcttttcccttggagacactgaataaactacrtgttgtggcctgcattttgactgcagcccatcacatgaggtcaggtgtggaacttgccatttgtactgccatgttggtactcaaaaagtttcaaattctg

SEQ ID NO: 1382 - DNA, 201 bp, Homo sapiens
attttcagatcctcctatattcaggtccttggggacccagtctcttgtgtgttttgtgtgccgacttgctcatcatgggtgatttccttgtggattttgtrgttttgaattctgagtttttccccactggagctttaactataaatcccatgtaaccccaaggcaagagaatatctctccagagtaattttacatttgctt

SEQ ID NO: 1383 - DNA, 201 bp, Homo sapiens; identical to SEQ ID NO: 721

SEQ ID NO: 1384 - DNA, 201 bp, Homo sapiens; identical to SEQ ID NO: 722

SEQ ID NO: 1385 - DNA, 201 bp, Homo sapiens; identical to SEQ ID NO: 723

SEQ ID NO: 1386 - DNA, 201 bp, Homo sapiens
aatgtatcagattatcatatgtactcccaaaatgtgttccctaatatgtatcaattaaaaaatgaaattaaaaatgtatttttatatatgtatgagttttrtgcatgctcaggagctaactggctgatttgatagaaacacacttctctatttctttacacttgggtagccattttctgaaaggtgttctatggaagttct

SEQ ID NO: 1387 - DNA, 201 bp, Homo sapiens
ttgagatggtaattatttacctaattgaccactctctcaactggatgcttttgaaagagcaggatcttactctctcttacagctccctcagcatggagtartgaagagtgttctttaataccaaagggacaaagaaagctgactgggatcggtctgccacatgctagttgcttcagttatttttttgcactaaattattgt

SEQ ID NO: 1388 - DNA, 201 bp, Homo sapiens
gagccgagattgtgccattgcactccagcccggacaacaagagcgaaactccatctcaaaaaaaaaaaaacaacaaaaaaagacggcacccctccttcccyggttatgctgcagtagcaaacaactctgaaatatcaggaacccgagacaaggcttgcatctcactggtgttccatctccactgcaagttacctaggaggg

SEQ ID NO: 1389 - DNA, 201 bp, Homo sapiens
ttgtttattactgggtggggtatccatattcttcacagaatggtcctgctgaaattgaatacatagttttgtgagtgtatactcacgtctgattgtcattrtgggggcagggaaggcatggacaggagagtgaagatctttaaccttcctcagtttcttaagggagtctgtggcctcccccccataaattaagagcttcta

SEQ ID NO: 1390 - DNA, 201 bp, Homo sapiens
aggtgtttgtttacatataagaacctgatgatggttttctccatgtgctagagactctagttgccttccagtatattttttccttcataagggaaggttcrttttatttgagccagcaatgcctccagctgagatcacgtatctcttatccttcgcctctcagtctgaccactggtctaagtcctggcgtcctggccattg

SEQ ID NO: 1391 - DNA, 201 bp, Homo sapiens
cggcctatgtctatgctcttaaaagatagctttgcataaccacatgcagtttcttccaactatatcccctatttcactcacatatcccttcttctaggaartcttactcatttaagtcctggcccaacccttttcctgagtcagtcctgactttatttatgagagctctcctcttaaatttttaagtgacagtttataatt

SEQ ID NO: 1392 - DNA, 201 bp, Homo sapiens
tagagtatgttttgaggccctggcctgcttctgggcgagggatggtaggtgtgagttcctctgcgccgcctttgcttgtgcccagctctctcttctctccrtgcttccttttctcctatttaaccttttttcccttagattgcttctccattgaccaaagagtggtataggtagcagctcagataactcctctgatgcaca

SEQ ID NO: 1393 - DNA, 201 bp, Homo sapiens
tgaacaaatggaaacagcataacctgctgtggaagcataagcatctttagagtatgttttgaggccctggcctgcttctgggcgagggatggtaggtgtgrgttcctctgcgccgcctttgcttgtgcccagctctctcttctctccgtgcttccttttctcctatttaaccttttttcccttagattgcttctccattga

SEQ ID NO: 1394 - DNA, 201 bp, Homo sapiens
caacatttcagtgaccgtatcaactgttcttctagatgtctggtgagagaccttcaaaaattgaagtcagtctttacatattcataattccactaattttsttacacattaatacttttccttaaagcattgcttacttactgaacttcatttaaattcttcttgtggttctgcagagagcttttgagccatctacatctc

SEQ ID NO: 1395 - DNA, 201 bp, Homo sapiens; identical to SEQ ID NO: 724

SEQ ID NO: 1396 - DNA, 201 bp, Homo sapiens
atcacaggcgtgagccacggcgcctggcctctttcctcgttttcgaattaattttagtgtttggggttttagtggggcttgttccccacttcagctaggcygttgctcagcgtcagtggctggagatgttggcagagtcagtccctccatccattaggtgctgaagggccactcagaagcccaaacttgcaagggtttttc

SEQ ID NO: 1397 - DNA, 201 bp, Homo sapiens
agctcgtgcccaccttcttgccatcgactcccccatttcactgcctgcctggcctctgtaggcacttgaatttacaacacgttttcttgccactaaccacrcatttccccacttgaaaagtattatttcttctctcttacagtttatcacatggtccagaactttctgtaagcgtcctgatttactttatttagagttatt

SEQ ID NO: 1398 - DNA, 201 bp, Homo sapiens
aacatttaggtgcccagtgcctttgctgacttgcagatttgaaacacttttctctggcatgcaggcctctgtgtttggtgctgtttcaggactaggatttwaaattttacagctcactctttcctcccctctaattcacactgtttaagtattttagatgtggagcacattttttgtatctagagggtaagtccttctctt

SEQ ID NO: 1399 - DNA, 201 bp, Homo sapiens
tggaattgctaggtcatgtcataattctgtgcttgacgttttgtggaaccaaaaagatatatcttaagtattaaaatagtacacatataaagttatcatasttccttcttatatattagaaagaaatggtttctttatagtcaggcagaaccaagttcaaatcccagcccctctactaactagctgtgaccttcagtgagt

SEQ ID NO: 1400 - DNA, 201 bp, Homo sapiens
catatgcacttgaaaaaatgtgtaacttgccgttgttgggtggagtgttctataaatgtcaatcaggccaaattggttgataatgtttttcaggtcttgtrtatccttactgattttactggtcagcttgggctgccataacaaaataccacagactgggtggcttaaggaacagaaattaattttcttacagacccagaa

SEQ ID NO: 1401 - DNA, 201 bp, Homo sapiens
aagaagggatgactgttaattagcaatgaagagagggaagggcattttacttcaggaagtaacatgaatttcagacccttaggagtgtggtacaggaagcrtgctttgaggcaaacccaggcttagattggagaagtccaggagggctcagttgatgaagggctttattttgtaagttctgaacctccagattttggcagt

SEQ ID NO: 1402 - DNA, 201 bp, Homo sapiens
cttagttactgcgtgcagctcttttctcaagctttttgggctatcttgcccactttcttgatttcaactacagtgaacgtgtattgtttgcttcccagctstctatttccaacccacactactctcctgatatttcttgagtcttatttcctttctttcttttattttatttttagaaatgaggtcttattcagttgccca

SEQ ID NO: 1403 - DNA, 201 bp, Homo sapiens
tacttccttgcctccaattcattactgtttttttttttccatattgacttcatatgtctctcttcattaaaaatatatatttgttacagagaatgcctctscctaccccctaccctgtcccccatcacccctctacagcaaagactgctttctgtgattctgtagttaccgcagacagatgtgtgcacaaacggcatagac

SEQ ID NO: 1404 - DNA, 201 bp, Homo sapiens
gcggcttccagaggaaatgtaaagactagtgagaaagcggaggtggggcacaggctcaaccagggcacttggcagtggggaaggggagagccagggacagrgaccgtgagatccaggcccagaatggggtgcactcaggagccacgaagcggggcaccgcagaaaccggaagcatccttcattcagtcccctggaactaga

SEQ ID NO: 1405 - DNA, 201 bp, Homo sapiens
ttgcttatatttagttttaatttttaattgtggtaaaatgtacataatataaaatgtacaatcttaactatttttgtgtatagtccagtagtattaagtaygttcatattgtgcaaccgatgtctataactcttctcatcttgcagaaatgaaactctgtatccattaaacaacttcccatttcccccttcctccgcccac

SEQ ID NO: 1406 - DNA, 201 bp, Homo sapiens; identical to SEQ ID NO: 725

SEQ ID NO: 1407 - DNA, 201 bp, Homo sapiens
ctccttaagcagattgtcccccaccccaccctttttggagagtttctaggattttattttgggggaataaataaatttctttccaactgggatggtggtgraaaggctgtttgtagactgtgggtggggaagggtttgaggccccactgctgtcatgcttgttcggtggcatttgcaccactggagatgattttagacagg

SEQ ID NO: 1408 - DNA, 201 bp, Homo sapiens
atatttttgagtttatacctaagttgtttttcagttacaactttgtcttattcaataacataaaaatgaacatttgttagcctttcattctagtttacgtrtataattttaaaaaatcttactaaacgtgatcctgaaatttcttataggcagttttctgttatcttaatgagaatatgttttcttataagcacaaaaaaa

SEQ ID NO: 1409 - DNA, 201 bp, Homo sapiens
ggtggttcctccagcaaccaaccttatcttctgggtccaggcaagagttgcctcattggcataaactcaagtgtgatggaaaagggctcatgatgaagaaygaaagatgccctctcacccctgtctcttggaaaattccaaggttttaggagctctatgccaggaactaggggaaagaccaaatacgtatttcttatttta

SEQ ID NO: 1410 - DNA, 201 bp, Homo sapiens
agaaatctttgttataagctactgaaatttgataatttgttaccacagtataacttagaaaaagctgactaatagtactcttttctaagcactttacaaayattattttaattagccctcataaaaacctgaggaactacggaatattctccctattatagatgaagaaactgaggcacagggaaattaactacagtcatg

SEQ ID NO: 1411 - DNA, 201 bp, Homo sapiens
tcaaactcctgacctcaggtgatccgcccgcctcagcctcccaaagtgctgggattacaggcgtgagccactgcgccctgcctgtgctagccatttctacrtgcattacctcacttcattcttagcataaccctgagaattaggtcagatgaagtgactgaagctcagagaggtcagatactgtgtccaatgacaagcatc

SEQ ID NO: 1412 - DNA, 201 bp, Homo sapiens; identical to SEQ ID NO: 726

SEQ ID NO: 1413 - DNA, 201 bp, Homo sapiens; identical to SEQ ID NO: 841

SEQ ID NO: 1414 - DNA, 201 bp, Homo sapiens
gggaagaagtgggggtgagctgggctggactcctgggaggccagcagtgttcttaagcctccccaggcatgtgaccagggcccagagccctgtcccacgcrtgcccctgggttgctggcagtaagggcatgcttacctgcctaggttttcctgggtgatgacagagggtggggggctgacgctgtccgtgccccctggaca

SEQ ID NO: 1415 - DNA, 201 bp, Homo sapiens
gaatacagttttcttccagcttctgaaggaaagcgtcacatccacactgctaagtgcacaaatcctaagcgtttggctagcagtatcttcacagaccgcamacacctccgaccagcacccagacccacaggcagagcgcgtcacgcccacaggcctcctggggcccctgtggtcactgtctcacccaccagaggcacttgg

SEQ ID NO: 1416 - DNA, 201 bp, Homo sapiens; identical to SEQ ID NO: 240

SEQ ID NO: 1417 - DNA, 201 bp, Homo sapiens; identical to SEQ ID NO: 843

SEQ ID NO: 1418 - DNA, 201 bp, Homo sapiens
gctaagcatgtccaggggcaggaaacagctattgcaggcccaggcgagacaggaggaagggaagaggagcaggtgtttgatgctgcatggatgcatcagcrtccgcgaagagacgtctgggtgaagagatgaatgtctcactgcacctgcagaattgggcagaaactcctcccagtctccatgatggtgctgtttccgctg

SEQ ID NO: 1419 - DNA, 201 bp, Homo sapiens
cctccttcatcacctccctgcaactgcgaatgcacagaagcatgacataaccttggggcagcagaaagctgctgcctcactcctgccacagctcatgatcyggagcctcacccctacccagcgcagcagtggcccccttcgcaccacactcccccaaatgccaagccttggctgctaatcaacagccacactctgaaaatg

SEQ ID NO: 1420 - DNA, 201 bp, Homo sapiens
ccccagtacagtgctgggatgacccaaaagcacactgggggaccagagaaatgctttcttccttggcttgaagatgatgtcatcaaccttcagggccctcrgaatcccttaaataataaaacagtcagagcacatgaataccgggatgctttcagcactgcatatgtcaagccctgaggctcccagaatccctggagacgt

SEQ ID NO: 1421 - DNA, 201 bp, Homo sapiens
cagtggctatccctggagagtgaaaatggtaggagggagacaaacatttcactacatatttgtttaaaccttttgaatgttgtgatatttgcatatattayctgtttaaatatacagatacacacacacacacatacacacacacacacacacacacacacacacacacacacaaagattaagatttagttttcaggttgg

SEQ ID NO: 1422 - DNA, 201 bp, Homo sapiens; identical to SEQ ID NO: 1043

SEQ ID NO: 1423 - DNA, 201 bp, Homo sapiens; identical to SEQ ID NO: 788

SEQ ID NO: 1424 - DNA, 201 bp, Homo sapiens; identical to SEQ ID NO: 789

SEQ ID NO: 1425 - DNA, 201 bp, Homo sapiens; identical to SEQ ID NO: 1315

SEQ ID NO: 1426 - DNA, 201 bp, Homo sapiens
agatggtttcttatgcagcaatagatactggataccaagtttattctgagaggcaacaggtccagctaaaatgatttgtttccccatactctcttgcaacwaggggtgaccacaaactaggacataaactgggaaacttttgtattcctgacacagggaatacccctttcaaactgctccctcacttctttcttcttccag

SEQ ID NO: 1427 - DNA, 201 bp, Homo sapiens
aacatctcataaaattatgccatgtgccctagaaactgggagtgccatacgtcccagatttcaccattttgctgagcttgaccttgagatgaccaatgccrggagctctctgctactctctgccctcgtcctcaagaccaggcatggagcacttacctctacccttttccaggccaggcttcctggaggcccagagggtca

SEQ ID NO: 1428 - DNA, 201 bp, Homo sapiens
agtgctttctttataatctttttttttttagacggagtctccctctgtggcctaggctggagtgcagtggcacgatctcagctcactgcagcctccaaatyctgggttcaagcaagtctcctgcttcagcctcccgagtagctgggactacaggcgtccaccaccatgcccagctaatttttgtatttttagtagagacga

SEQ ID NO: 1429 - DNA, 201 bp, Homo sapiens
accttaccttcaattcttctgaagatttcacttttgttatcccagtggctccaaacttctctccatcaagcatgcattttatttctcctttttatgcccamtgttttgaaatactcaatcctaataaaagggcatgtttcaagaaataattagtagtcctttcccaatttggtgttcctctttggaactcttaactgagga

SEQ ID NO: 1430 - DNA, 201 bp, Homo sapiens
tgctatgacgtcacctctatggaatttaaactcacagaacctgagttcaattcttagagcaactagttctgaggcactttctagtcccccattttacaggrtgggaagaattgaatctcaaagtagggaaaaaactttccttccaccttcacctctccacttctggctgaaatggccctgaaagactcagctcttccctac

SEQ ID NO: 1431 - DNA, 201 bp, Homo sapiens
aagataaaagcattttatgaaagtaatcacaaaattttaaaaaaatatattttttataaaatgctttcaaactttcctatattttgaaaccatagtattcmaactttccagcacttacagagcatttcagattagataaggtcactaaatgaaagaataacatgtataactaatcacattattaatcgtttggtagatgct

SEQ ID NO: 1432 - DNA, 201 bp, Homo sapiens
caaggatctgggtggttttctttgttgttgttgttgttgttgttgttggcttctggagtaaagttccagtccccaatcatcctcccttcaacaactcagcygctatgacgtcacctctatggaatttaaactcacagaacctgagttcaattcttagagcaactagttctgaggcactttctagtcccccattttacagga

SEQ ID NO: 1433 - DNA, 201 bp, Homo sapiens
atctttttctattgagatgtttgtcattttctcatcaatgtgtttattagaaaaaataacttctggctagtcatatgtattgcaaatatttccctcagccygtagtttgatttttatttattatgtgttttgttctataaaaatttaaagagttatgtaatcaataatgcttattaatttttctttatgtcttacatttct

SEQ ID NO: 1434 - DNA, 201 bp, Homo sapiens
gccacactgggggaatcaccctcatctgggctgccctgactctccagagccagtaggcagaaaagacagatcattgatccacaataccacagctgtccctyctcctaggaggtcctctcagggttatcagtgccccatccataaacccctggctggggatactgagattcccactgggaggccccaaccagcactttggga

SEQ ID NO: 1435 - DNA, 201 bp, Homo sapiens
aaatctaatacttcttaaaccgaggaataggtaatagtacctttgagtactgctactttgaaggctatccttccatgaaggaaattaaggacaactagagraaacagaggaatggtcttaagaaaggaaaaaagagggtaaggataaatggagaagcaagttgagggcacctgtggatcagttatggggatatgcccatat

SEQ ID NO: 1436 - DNA, 201 bp, Homo sapiens
gcatgaatacctagtcccttttcctatagagaggtatcaacccaggcacacagtagcaattttataacctcctgttgattacttaatggaagttattaaaktttaaaatgagcctattacaggttatgtggatcctgaaagagtaaatgaccactagtggaaatgaaatcaactaggcaaaaaggacaaatctaatacttc

SEQ ID NO: 1437 - DNA, 201 bp, Homo sapiens; identical to SEQ ID NO: 1429

SEQ ID NO: 1438 - DNA, 201 bp, Homo sapiens
gtcatagctcataagtatccagacttcaccatcttctcccttttcttcagcacaaagtgaatgcattaagaaataagtaatttttttttctcccttggaaktgatcaaagctacatacaactggttctcgaattcttttttttttatacagagtcttgctctgtcgcccaggctggagtgcaatggctcgatcttgactca

SEQ ID NO: 1439 - DNA, 201 bp, Homo sapiens
tgaatataatatttaatccattccacttttgatagatatttggattgtatccaagttagagtcttatgaatgtttctatgaccacttttatatatggcacygggcatacatatagatattcctgttgggtatatacctagaagtggaatttttgggtcataggatatgcatatgttcagttttaggagatctgccaaacag

SEQ ID NO: 1440 - DNA, 201 bp, Homo sapiens
agaagtggaatttttgggtcataggatatgcatatgttcagttttaggagatctgccaaacagttttccaaattggttatatcagtatacattctcatcarcagaatatgagacttccagtgatgctgatttttctgcaacatttaggtttcttaaaaactttttttttttttttagatggagtcttgctttgttgcccag

SEQ ID NO: 1441 - DNA, 201 bp, Homo sapiens
tccagtcgtcttctagagtccttctttaaccttctttccaacctcttgacctttccactattactagtgtcatagctcataagtatccagacttcaccatyttctcccttttcttcagcacaaagtgaatgcattaagaaataagtaatttttttttctcccttggaagtgatcaaagctacatacaactggttctcgaat

SEQ ID NO: 1442 - DNA, 201 bp, Homo sapiens
ccttctcccatctacccccctcattctctattgctctacttttctagaaccaaataggaaggaaaataagagtcaaagaaaaggataaaattctgacatgrattgcatcattgcatgaacaaggcagtgattttccctctgcctgaaagtctttatatttgttcagaaattttcaatgaagcaaaagagatttctttgtgc

SEQ ID NO: 1443 - DNA, 201 bp, Homo sapiens; identical to SEQ ID NO: 1430

SEQ ID NO: 1444 - DNA, 201 bp, Homo sapiens
cttctcattttgtccctgttgacacaagcaacattgcctttgcttggcatgaaacccagcagcagggcctaggcacagagatcagctccctaactattctrttgatgcaacagcatcactggatgtctcatatctgagatactgctgatctgttctcctcttggtttgggcacaaaccatgcagatgggacattagtgatg

SEQ ID NO: 1445 - DNA, 201 bp, Homo sapiens
tggaataatacagtgtgtattattttgtgtctggcttcttttgctcaacatcatgtttggaaagtccgtctatattgtggatgttgttcattcaatttcaytgttatataatattccattgaatgaatataatatttaatccattccacttttgatagatatttggattgtatccaagttagagtcttatgaatgtttcta

SEQ ID NO: 1446 - DNA, 201 bp, Homo sapiens
ctgaggaaccttgagaatctacccttttcaaacttaacaacccttctagactccagaatccatggatttaactgcttcttaagaaagcgtcctctttgtaytctccaagtcctgtgtttgcttaaactcactccctttgcctgatctgctcctgcagtctcccacaggatccacaatgtgctggcctctagagcttcccta

SEQ ID NO: 1447 - DNA, 201 bp, Homo sapiens
cattttcaaaagaaaatattgtatggcattagtcatttggaattttttaggctttctttgtaatctaagtcattgtaactaagtactcaaacctgctcaaytgggccgggtgtgatggctcacaccagcacttttggaggcagaggtgggtggattgcttgaggccaggagttcaagaccagcctggccaacatggagaaa

SEQ ID NO: 1448 - DNA, 201 bp, Homo sapiens
tttcatttaatcaaatattgcagaaataatttattttctataaaatgattttgggagcaagtactgttttctttatgtatactgcacacaagtgcataaaycattagtggatttttactacatacatacccatctagacaccacccagattaagaaagagatcatcagataatattcctcttctctcatccaagaaaaggt

SEQ ID NO: 1449 - DNA, 201 bp, Homo sapiens; identical to SEQ ID NO: 1431

SEQ ID NO: 1450 - DNA, 201 bp, Homo sapiens; identical to SEQ ID NO: 1432

SEQ ID NO: 1451 - DNA, 201 bp, Homo sapiens
tgcagatggagggctcctagacttaaaaagactcttcagggcactatgtgaaaatagaagagatcctctgacttgagacagagcaagaacctatggggaawttctagactccagaaaagaatccagaccttttatatccattataagagggagcaaaaggaaaaaagaaagtacagaaattccaaattgaacaccaagttc

SEQ ID NO: 1452 - DNA, 201 bp, Homo sapiens; identical to SEQ ID NO: 1433

SEQ ID NO: 1453 - DNA, 201 bp, Homo sapiens
ctggcagaaccacaatgccaaggagtatcagcaatttggacatctgagtaaagctggcaggagactcaggattttaccaggctctgctgggggtagaaaarggttccagatgaggagtttggagaatgtgtgactcgactctcactaccttatctggttctgcctcctccactcctctggccatcactccctgggtgggca

SEQ ID NO: 1454 - DNA, 201 bp, Homo sapiens
gataaatggagaagcaagttgagggcacctgtggatcagttatggggatatgcccatatacgggtggttgcttcctacagatattgggtacatgtagaagrgagaggtctttggggacctggtcgagaaaaagtggctatgtgatgagtggcagggatgggaagtcagtgaagaagtcaaagctcttggacagaaagaaga

SEQ ID NO: 1455 - DNA, 201 bp, Homo sapiens
tgaaaaatatacatttgaaaaacagaaaagaacaaagagaagtaatgagatagtagttattccttacctagagataataactgttgataatttactacgtrtccagatttttttactgtatcaatacatatatcatctgaatttatatctaatctttacctctactcatatataatctatatatatgtgtttttcatcaaa

SEQ ID NO: 1456 - DNA, 201 bp, Homo sapiens
actaccttatctggttctgcctcctccactcctctggccatcactccctgggtgggcactggcttctcacaaagtacttcctttttcttatagctcatacwcctctcattgcagaaataaattctccacacttttttttaatttttgaaatttgaaaaatatacatttgaaaaacagaaaagaacaaagagaagtaatgag

SEQ ID NO: 1457 - DNA, 201 bp, Homo sapiens
cgttcctgcaaatatttcacagaggagtaagagccacattcttgctggctttccaattcattctcctctcttcgagtccacctcttaaaacttcttagtgmtcttgcaagaaactcatgtcttttgtcagggagaatggcatggcctttgtatgacacttccttctagccagactcggatttgggggcatcatatttggga

SEQ ID NO: 1458 - DNA, 201 bp, Homo sapiens
ttgtctgcttggttgttcagtgccacctcaggggcaggtattttctgggcagatggggtgttaacttggggtttgggctcattccacatggaccatttccrtctcatgatggacactgttgggcctgtccaatctataactctgtaggtcacacagaagccaattcatacaaccacttggaattacgtggttctcagtgtc

SEQ ID NO: 1459 - DNA, 201 bp, Homo sapiens
gccaattcatacaaccacttggaattacgtggttctcagtgtcctgtggtcaagaattctatctgatcagggccagcaacactaaaagttgcttcgagaarggggcatatatttctgctgtggatgacatgaacttactccagaatcccaggccctccattgtgactttccccactgatgctcagttcactccatcctgca

SEQ ID NO: 1460 - DNA, 201 bp, Homo sapiens
ctctttcagctactactgctggttggttttaaaaaaacaagacaatagtaaaaattggagacaagtgtttggccataaagagaaacactggctacctcccrtattttcaagcatgggtgatggttgcaaggtgatccagctcaccttgtaggggatgaatccagaaaaagcctctgttacaaatcaaaatggacatgccgg

SEQ ID NO: 1461 - DNA, 201 bp, Homo sapiens; identical to SEQ ID NO: 493

SEQ ID NO: 1462 - DNA, 201 bp, Homo sapiens; identical to SEQ ID NO: 494

SEQ ID NO: 1463 - DNA, 201 bp, Homo sapiens; identical to SEQ ID NO: 495

SEQ ID NO: 1464 - DNA, 201 bp, Homo sapiens; identical to SEQ ID NO: 496

SEQ ID NO: 1465 - DNA, 201 bp, Homo sapiens
ataagttatttgacatttgttaggtataacttactcacatgtaagagggggataatgtcatagttatcttatgagggtggtaggagatgtagatacaaaaytgaaaagcatctagcagtgccaaatacctgtgagtgcctccacagatgttgacttgcttcctctttttctttatgctgtgaacaatcctccattgccttc

SEQ ID NO: 1466 - DNA, 201 bp, Homo sapiens
actctgcccggtctcctcctcccttcctcacctaccaccacttctaacctcccactacccgttgcagattggatcatgatggacacctgactcatggtggrcaaactggatcttttcttctgggaattagacttggaaattcagagaaaacaagtcagtttgtatgcatgccttggattgagagacatgaacattttggac

SEQ ID NO: 1467 - DNA, 201 bp, Homo sapiens; identical to SEQ ID NO: 684

SEQ ID NO: 1468 - DNA, 201 bp, Homo sapiens; identical to SEQ ID NO: 689

SEQ ID NO: 1469 - DNA, 201 bp, Homo sapiens; identical to SEQ ID NO: 690

SEQ ID NO: 1470 - DNA, 201 bp, Homo sapiens; identical to SEQ ID NO: 692

SEQ ID NO: 1471 - DNA, 201 bp, Homo sapiens; identical to SEQ ID NO: 698

SEQ ID NO: 1472 - DNA, 201 bp, Homo sapiens; identical to SEQ ID NO: 699

SEQ ID NO: 1473 - DNA, 201 bp, Homo sapiens; identical to SEQ ID NO: 201

SEQ ID NO: 1474 - DNA, 201 bp, Homo sapiens; identical to SEQ ID NO: 701

SEQ ID NO: 1475 - DNA, 201 bp, Homo sapiens; identical to SEQ ID NO: 702

SEQ ID NO: 1476 - DNA, 201 bp, Homo sapiens
tagagcgacatcagtgttcccagggggagggacctggaccctctcctgtgttgcaggcggaaggtgggtgggtggatggtgaactgtaaacgctggtctgkgaggcggccacatggcaccaggagcagggtctttcgtagcctctgtgccccttgctctaggtcattctccttcgaaggatgccttctgaagaagcaatca

SEQ ID NO: 1477 - DNA, 201 bp, Homo sapiens
gtgcacagggactgcagacgtggtgttagggacagagtcccaggtggcataaagtcgggttggtccttggcaaaagactcagggtggcagaatgctttcartacctccctcctttcctctgtcaccccaaaccacagcaaaagagacaggatgaccccagccctttgctcccaagggactgactcccaaactcctccttta

SEQ ID NO: 1478 - DNA, 201 bp, Homo sapiens
cacactcaggcacccacacgagtgagagcccgcacacaccacagaccccggaaggacagcaagacttcctggccccacacatgtgccctggttcaccctcrtgcccgtatgcacaaacacacacgcacggtgcactcatgagtacacgctgtaacctgcgtggggtggctctgtcagccgaccgggtgggtgagaggagaa

SEQ ID NO: 1479 - DNA, 201 bp, Homo sapiens
aatcattatctgaaatgtttcattgtagaagcagcaatgtgggctccaagtagatgcagcagatccacatgtccctctgagggaaagccatggtgccaatrggcaagaacaccatgatgtgcaaggccatccaagggcacctggaaaacaacccagctctggaaaaactgttgcctcatatccagggaaatgtgggctttg

SEQ ID NO: 1480 - DNA, 201 bp, Homo sapiens
cgttgccaccaacacaaccacactgggcaccaagctggaagcttgacacttgttgaaaaatttctccatttcaatgtcagcaccaaagccagcttcagtcwctacaaatccttcttcaccaaccagtttcagggcaattttgtcagccaacactgaagaattgccatgggtgatgttagcaaaagggcccacgtgcatgaa

SEQ ID NO: 1481 - DNA, 201 bp, Homo sapiens
ttgacacagcgcagcacactggctgtggcagactgtggaagactgactctttaggccagaccctaacccatccctcctcactgggaggggcctttctgcasgaaagccagcaactccagccagggccttagggacagaactctgatctcgttgggccctagggggaagggtggctgtggtctctgcagaccagcagactta

SEQ ID NO: 1482 - DNA, 201 bp, Homo sapiens
gggggataatgtgtagaatgtgcaggtttgttacataggtacacaggtgccatggtggtttgctgcacctatttacccattctctaagttccctctcctarcccacatcccccaacaggccctggtaatgtgtttttcccctgcctgtgtccatgcattctcattgttcagttcccacttacgagtgagaacatgcggtgt

SEQ ID NO: 1483 - DNA, 201 bp, Homo sapiens
taaactagacacacaagccataagataatataataaacattcacacacccaccactaaaatgatgtatatatcaacattttgtcatatttgcttccaatcyctcctaaaaatgaatacataaaaatgtactgatacaactaaaggctcaaacctgcatctctcactgatcttttcgaaacttctgaagctaatatgcatta

SEQ ID NO: 1484 - DNA, 201 bp, Homo sapiens
gcaggtcacagaggaggaagaccagcactctgagcaggatggtcatgtacagcctggtcaagggcatcttccgggatccacaaaggatcctgaccagcagraccgggctggacccgcagagaaccacacataaaaaaatcagccatgtgactgtgatgaaatctgatgtttcacaccaaacagaatcagcaccactagaca

SEQ ID NO: 1485 - DNA, 201 bp, Homo sapiens
ctgtggcttacagtttagggtctttaaagacagactatatcaggcttttgatttcatctctgccatctgagtggtctttctgtttgtggttctcactaggkccagtctgactctgctggtcagtgtccagtgtgtttcccagcagacacagctgcccaggctctatgtgatcatcctgctcatggttctggccttcttttc

SEQ ID NO: 1486 - DNA, 201 bp, Homo sapiens
ttggtacatacccttacctttcctccttcttcaagtccaaagataaagagctgccccttgctaaaggggtagagcctttctgggattccgtgacttcagarcactattctgtgttgtgtcatttaggagatgcctacaagagctggaatgagaactggcaaccaacccaggtttatgaagatacagacagcatgtgatttc

SEQ ID NO: 1487 - DNA, 201 bp, Homo sapiens
gatcaacatgtcatatagtttggcttaacccatattaataaaaatgtttttttttcacctctggcaactggagaaaacaaaatctagtcaccttttcagamcctctgacatttaacgttctggctcctagttacctttccatcttcatttattactattccaattctcctattttctgggatcatcctccaaaactccacc

SEQ ID NO: 1488 - DNA, 201 bp, Homo sapiens
gaaacaactagcctggccaaggaccccaacttttggaggaggatactgaggcacagggggaggaaatctcttgtctggggtagcccagtgagttaatggcygaaaagtctcctgaatctggaccagacatggtcagggatctctggcaacaggccacagaaatgatcattggctgatttaggtgaaggggagtttactgga

SEQ ID NO: 1489 - DNA, 201 bp, Homo sapiens
tcaactttgctctgtaatatttcttttgatgtcataactttgttgtaggaagggccagtgacaggacctaaatgtctctgattgtttattcttcaagtccygcatctcagattctgcaggtccccggcagcaggaatgtgatgatgtaagcaacaagtgcgccctctggtgccatatataaaacttgcgaaaaggatctgc

SEQ ID NO: 1490 - DNA, 201 bp, Homo sapiens
gtttatccttcatctttgaacaaaatgaatacttcaaacaatgcagcatagctgcagttgctaggaagacagagcagcaacagaagctgcctggatacaargccatcagaaaactctcattttttccctccctccctccctcccttgcttccttccttccttcttcccctcttcccaccctctttcccctcttttcagtga

SEQ ID NO: 1491 - DNA, 201 bp, Homo sapiens
ttaatttttgtataaggtgtaaggacagcctgtcttgccttcagcagccacctcaacagccatcaatatcaggcaagaccttccagcaggaaaatgtttgrcttgataaaggttctgatgatggttaccatttcctagtaaaaatatttcttaagtaatacatgtatattgctttagacataaggccactgcaactcaata

SEQ ID NO: 1492 - DNA, 201 bp, Homo sapiens; identical to SEQ ID NO: 1056

SEQ ID NO: 1493 - DNA, 201 bp, Homo sapiens
atattattagcaatgattaaaaaaaagaaagtagactagctgggaaagtagactagtaagtaagaagataaaaaaggaagatagattctgccaaatcattyttatagagtcatgaataaaattcacgtaattatgaaaatgtatctgcagtttattcaaataaaatcagctaaatgggagaagctcttcttattttgtaaa

SEQ ID NO: 1494 - DNA, 201 bp, Homo sapiens
ttctctgggagcctccatctttggctcacagtgggtgggcacaggcacctcacaaggcctgacagaggccagtccccgatcagtgtagggagagcagagcrttggaaaccattgaccaacttcacctccatcacttccagcgaagtcaggggcatactgcacccccacatatttgtaggttgaagtcctaacctccagtac

SEQ ID NO: 1495 - DNA, 201 bp, Homo sapiens; identical to SEQ ID NO: 1215

SEQ ID NO: 1496 - DNA, 201 bp, Homo sapiens; identical to SEQ ID NO: 1216

SEQ ID NO: 1497 - DNA, 201 bp, Homo sapiens; identical to SEQ ID NO: 1217

SEQ ID NO: 1498 - DNA, 201 bp, Homo sapiens
gaccaacctgcaatgctcaggaaaccccacaggcagtagcagaaaacaaaggccctagagtggccattcttacctgaggagacggtgaccgtggtcccttkgccccagacgtccatgtagtagtagtagtagtaatcacaatggcagaatgtccatcctcaccccacaaaaacccagccacccagagaccttctgtctccg

SEQ ID NO: 1499 - DNA, 201 bp, Homo sapiens
aaaaatgagtcagcagggagagctacaaattgcatcttgttatcaaaacagcataaaatagcctcccccaactgtgggacatttcatcctggtatggcccygttttcacagcctggtataagcttaggaatcaaacacacccaggttcaaatcccagctctaattcttcttggcttgtgtgacgtttcactcctctgggcc

SEQ ID NO: 1500 - DNA, 201 bp, Homo sapiens
acctgaaaatgcatactacacatggttcctttaaacttgaagaaattaaccaagtatacgaaaagagttgatgcataggcttgctaccaattccattttcscatgatggagtgtgctttctgaagctaacattctaagattatattccaaatttcctgaacaaaatgtacttattgcatagcaagacttgcccctgagatc

SEQ ID NO: 1501 - DNA, 201 bp, Homo sapiens
gtgttctctctgctatcttgcactgcctgccaaaaaattcaggtgaccacagacaaggacacaccaggagcgtacctgagttgacagtgagatgactgatragacgtccccagcatgaggttttaaccatggacatagatctttggactagcaaagccaggtctcccgttataagtggaccatcctttctgagttccagac

SEQ ID NO: 1502 - DNA, 201 bp, Homo sapiens
ccagaatggcattgggggtttagggtcccatggcggggggtgtaagtggagaaaaactatatgtgaaaattaacttggggatactggattgacattcaggrctaaacatgtttggatccagcagtcttatgtttttgaatgaaaaaaaattggaagacatggttttcttggttacacatgttctgttttgtcaaaatgtgc

SEQ ID NO: 1503 - DNA, 201 bp, Homo sapiens
ccatgcccaggaaggcttcacaaagtatttacccaaattattattttaaatgggttatcaaggtgggcacatggcttcccttctctttgcttgcaaagaayatcaaagggctgggcaatgcaaaggtgatagagcccagaatggcattgggggtttagggtcccatggcggggggtgtaagtggagaaaaactatatgtga

SEQ ID NO: 1504 - DNA, 201 bp, Homo sapiens
tcaatacctggaaagctctgtgagggccaaagccttctctgttttgtttattgctgaaatccccagaagttaggatagtccaggcacattgtagctgctcycaaaatatctattgactgagcaaatggatgattcaatgcccagccatggcaggggtaaggcgctgggaatgggctgaagaagcacagccctcaactttag

SEQ ID NO: 1505 - DNA, 201 bp, Homo sapiens
ttagtgcacatttatttctcaaatgcaatctgagttagattcatctataaaagcaacccattttgcaaaagtcggcttcaggacctcccaaagaaagagcmacatgttgtgtgtctcagcctggaaatgcaaactggccaagcccacacctttgtcctagcagaaagcaggtagtggtagcccctgactttagatcatcca

SEQ ID NO: 1506 - DNA, 201 bp, Homo sapiens
ccctagatgctaatggtttctttcctagcatgtctcacagctgggaatcacagatttattctttgtccctctcaatacctggaaagctctgtgagggccaragccttctctgttttgtttattgctgaaatccccagaagttaggatagtccaggcacattgtagctgctctcaaaatatctattgactgagcaaatggat

SEQ ID NO: 1507 - DNA, 201 bp, Homo sapiens
taatcatcaatggcaaatacatcaatgggctaagcacaagtactgtgggaacagagatcacaggaaccagctctgtcccactgggaggtgatgggataccrttaaaacttcccatgggatgtaatattgacatttgaaaaatggtagacaagcagattcaagaataagtatatatagctgggcacagtggctcatgcctgt

SEQ ID NO: 1508 - DNA, 201 bp, Homo sapiens
atgttctaacccaacgcaaggaagctaagaatcttgaaaaagggttagacaaattgctaactggaataaccagtttaaagaagaacataaatgacatgatygagctgaaaaacacagcatgagaacttcatgaagcatacacaagtatcaatagctgaattgatcagacagaagaaaggatatcagatactgaagattaac

SEQ ID NO: 1509 - DNA, 201 bp, Homo sapiens
cacctcctggcctttcagagtatggagacgtggaaattctgagtaggtgagttccatctcagaggacactcaggggaaagcgtgctgtgcttcttaaactmtgatctatcctatagttttctcagctcctgcactgttggcgtttggggctggatcactctttgctgtaggcagctgtcctgtgtatttgcagggtgctta

SEQ ID NO: 1510 - DNA, 201 bp, Homo sapiens
tgaatgaaaaaaaattggaagacatggttttcttggttacacatgttctgttttgtcaaaatgtgcccgattgccctttcttctgtctgtatgcctggtgmcattttaactaaactcctcatcccactcccaagccctacaacacttcaactaccccttcaggacctctctagccaacatcatcttccccctctcctacca

SEQ ID NO: 1511 - DNA, 201 bp, Homo sapiens
taacttggggatactggattgacattcaggactaaacatgtttggatccagcagtcttatgtttttgaatgaaaaaaaattggaagacatggttttcttgsttacacatgttctgttttgtcaaaatgtgcccgattgccctttcttctgtctgtatgcctggtgacattttaactaaactcctcatcccactcccaagcc

SEQ ID NO: 1512 - DNA, 201 bp, Homo sapiens
tgctcagaagtgaggagtttcctgggccgtgggacagtccacgctgaaactggtaaagtcccgggcaagttggaatgagttggttatccaacttgaggctrttggtggagttatctgggggatggtttgtagggaacaaacctccaaaattcaaattccaacccactgaatgatagggttctcactcacactgggttggat

SEQ ID NO: 1513 - DNA, 201 bp, Homo sapiens; identical to SEQ ID NO: 1457

SEQ ID NO: 1514 - DNA, 201 bp, Homo sapiens
gctgccctggaatttttggttcaaagcttacttgctctggaaacacttccattagctaaacttctaccctttagtcacagctttcttgacatcagtgcttsgtatgtgtgcacacattttcatgcttcagtgagtaataatgcacatacccatgctcaagtgcagagtcaaggaaaaggaggactttgcccctcctaccta

SEQ ID NO: 1515 - DNA, 201 bp, Homo sapiens
gcccagctggtggtgagtgagcaggtgtctgggctccaagccttctgggagctggtggggaggaagagcaggcagggcactgggcctgcctctgaaagggyggatagaagatgccgtggatgaaggcgccttcagggtgggggagccagtccagcctgagccagggccctagggaagttgcgggagggggcagggtgtggt

SEQ ID NO: 1516 - DNA, 201 bp, Homo sapiens
acatttcaaataagatgtttcagatgatgtaagctattagtaaagaagaattcagttttggtgaaataaatgagcaatagtaagtatacacaatgaaatamtgcacgtgttcatttgagaaagtatttgactacacacacaacaccatgctatctactgagaagattttgaaggcttgtaggccagtcattgtaatcaatc

SEQ ID NO: 1517 - DNA, 201 bp, Homo sapiens
cgcctcggaggaacgagcactctttctccccgagctcctcggcaagggtttcatcacagagtggaggagaaagacccacagaatttacccatctgaacaayccagagaaagcaggctgaggaaaatgcgcagatattcgtatccaacatgtgtatcttcagagtcccagggtaaggggaggaacatgaggctgaaagtcgg

SEQ ID NO: 1518 - DNA, 201 bp, Homo sapiens
taaaagccccacctccgagaggcacaggagggcaattcacggagggtgttttcgaaccgggacagacggcttcaggaagcctttaggaactgttctgcctrtgagggccgtgaacaggggcagttaggaccctgctgggtgagggaggttttgatgggtgcatctcggcaccaggacacctgcacagcacacaccacggct

SEQ ID NO: 1519 - DNA, 201 bp, Homo sapiens
aattccaggcagggcaatggggtcgccttgtgaactaagatgcagatggagaagagcagacacagacacaggtcttggggcccctgcaggggtttctcacyggctttttccccctggattcctatgggttctggggaacagagttaggtcggctggcaagacagatgcatgaggctgtggcgcccttgacattgagccgga

SEQ ID NO: 1520 - DNA, 201 bp, Homo sapiens
agtagctgggtctacaggcataagccaccaactcctggctaatttatgaattttttgttgagacggggtttcaccatgttgcccaggctcgtcttgaactygagctcaaaatgatctgcttgccttggcgtcctaaagtgctgggattacaggcctgagccactgagcccggcctctaaaaaactttgtattaacaacttt

SEQ ID NO: 1521 - DNA, 201 bp, Homo sapiens
gaggtgaagttacttgtataaggtcacacagccaggaagtagagaactggaactagattgaaccctcagcctagcaatgtcactatgctacacttttcctrgtgtggtctacccgagatgaggggctgaggtttttttttgtttttgtttctgttttgaggcagactcactctctcccccaggatggagtacagtggtgcg

SEQ ID NO: 1522 - DNA, 201 bp, Homo sapiens
tgagcccgcctgaccccttaggctgggctcagtaccctaccttgtcttcccaccagccgcctccctccatcaagttcctttccacgtctgcttgtgccccygttgtccctcagtttgtccaccctcctccaatcttcccctccccaaacccatgactgatcagtggcccccaacctaggctcccacctccatgcaggtctt

SEQ ID NO: 1523 - DNA, 201 bp, Homo sapiens
ctcaaggagatatctgcatttctgtgttcattgcagcattttccccaatacccaagatgtagaaacagcctaaatgttcattgtcttgacagatgaatgcrggtaaagaaaatgtgatgtatgcaaaccatggaatactattcagctttaaaaaaagaacattttacaataggtgacaacatggatgaactttgaggacat

SEQ ID NO: 1524 - DNA, 201 bp, Homo sapiens
agttttctcatctgtgaaatggcctaacaacagtacctactccatagggttgttgtaattactagatgagtcaatagaagaacttaaaggagtgactggcrctcgggaaatggtataaatgtctgttgaataaactaatatcagttttaggtccatgtgcatgcacatgtgtgtgtacatgtgtgtaaggacctgtgtgca

SEQ ID NO: 1525 - DNA, 201 bp, Homo sapiens
aggcttaggaagtgttgatctgcttctgaggctaccagcaggctactatttgcctctttaactccccaatgcaagttaattaatgcaagttaattagaagyccagccaccaagtagcccctagaagagtgtcataaacccctcccagagaaaaacaagaagctgcatttttttaagtccttctctgcactgcctccagaga

SEQ ID NO: 1526 - DNA, 201 bp, Homo sapiens
gcttaatagtgagcatcagaactaaaacattgcactggacctaactcattgccctgtcattgtttcccagtgtaaggaaaacttatagtgagcaccacagyttaaatgccctggaacaatattgctgccctactattgtttctcagtgtgggaaaaacttaggtgggtactgaaaatcttgaccttttagttgtttctggg

SEQ ID NO: 1527 - DNA, 201 bp, Homo sapiens
tccattcttctagtactcattcattcccttaacattgccatcagatcggttttttgctaacataactctaatatttatgtagctcttcagtttcttttgtwggactgtcattgctaccaaattatatgcatatatggtttaggtatctatatctgtgtgtgtgtaaatatacatttttttatgtgtatgtatagtcatcta

SEQ ID NO: 1528 - DNA, 201 bp, Homo sapiens
tacaacgcacaagacagccgcctacaagaaagaagcctcggacccaaaatgtcaaggttgagaaatgccatctagatagatggatcaagagtagagagaartcacaagtaaacaatattaaggatgagaaatggggccatgtctgcaagtactgcaaaacttaaaaaagaaaataagaatattaacttcatgcaaaaatgg

SEQ ID NO: 1529 - DNA, 201 bp, Homo sapiens
cttgtgggttcagatcgcctcctcatgccttcactgtgcaggttgacatgttcattcctcacaggttcccctgccaggccttggatagcctgaaccaatawaacacaaggaaaatgacaattttcctggaagccctggtcctgaggctttctgcctatgtcccctctccacctcccggctctcacggccccacatagactc

SEQ ID NO: 1530 - DNA, 201 bp, Homo sapiens
gttgaaggttgaggtaccaatttcattattgctgactataggagttatagcaaaatatccatttgtctgttacatgagttaaaaatatggttgttgcactrtgaatagtttggtttagtcaaaacagttgtatcttaacggattgagaaacaaaagcaggaccacttttcatcagctccctccttctccttaaccagcaat

SEQ ID NO: 1531 - DNA, 201 bp, Homo sapiens
ggagccatgagaccagccactatttcaccctctccatccctccactttcagatgtatgtggcgcctccaaagcccgagctcttcttggcgtctgtggcttsaataagcttgctttttgctggtatccctcctaccctcccctgtccccagcaaagcttgcatttgaacttcttcctacgggctaacaaatcagtcagttat

SEQ ID NO: 1532 - DNA, 201 bp, Homo sapiens
gaggtgggggaggggctgcttcctgggctgccttggattggagggaagacctcaggtgagtgggtgggaatttgcccaaggagccatgagaccagccactrtttcaccctctccatccctccactttcagatgtatgtggcgcctccaaagcccgagctcttcttggcgtctgtggcttcaataagcttgctttttgctgg

SEQ ID NO: 1533 - DNA, 201 bp, Homo sapiens
tgaactgtgattgtgccactgtgttccatcctgggcaacagaatgagaccctgtctcaaaaacaaaaacagttactagaagaatggacatcataaagatargagcagaagtcagtaaaatagaaaacaaaaatacataggaaatcaataaaaccaaaagctggttcatcaagaacatcaataaattggtaaagctgatagg

SEQ ID NO: 1534 - DNA, 201 bp, Homo sapiens; identical to SEQ ID NO: 744

SEQ ID NO: 1535 - DNA, 201 bp, Homo sapiens; identical to SEQ ID NO: 745

SEQ ID NO: 1536 - DNA, 201 bp, Homo sapiens
aaataaatgtatataacattgaacacagatggatataaacatgggaccagtagatactctggaccactagaagtaggggagagaggtagtggggagggggktgaaaagctacctattgggtgctatgctccctacctgggtgcaatacacccatgtaacaaacctgcacatgtacccccataatcaaaaataaaagctgaa

SEQ ID NO: 1537 - DNA, 201 bp, Homo sapiens
acgaaaaactctcatagtgaagccaaagcacattaatcctcctaatctgctttcagagtaatgaggcacaagcctttgtcgctggcatgctctgtctgccrtgctaacacagtcagtggtaatcacagccaccactcacaattaggaaggctaaaggcaaagaactagggtgagaggtgactacaccaccatcccggtctt

SEQ ID NO: 1538 - DNA, 201 bp, Homo sapiens
catttatggtatcttaccaaagaactcattttacagtaaaataggtaagaaaaaggccaacactcataagattcatgggtatgatcatgtactccattagstgacttgatgaaatggtacaatagcctaatgttgactgattcatgttccttactggttgacaaatcctgcaggaatactgagctcccctatcaggttgcg

SEQ ID NO: 1539 - DNA, 201 bp, Homo sapiens
cgtggtgggttgattacatagaggcatcagtgatgatttgttctcaaatagacatgtagtctggatatggatctgtatttcctacctgcaatgcttgtatmagtataacaatttgtgaagttgctgaatgccttgtttgccatttatggtatcctgccatttatggtatcttaccaaagaactcattttacagtaaaatag

SEQ ID NO: 1540 - DNA, 201 bp, Homo sapiens; identical to SEQ ID NO: 746

SEQ ID NO: 1541 - DNA, 201 bp, Homo sapiens
tcctgaaatgtaaccatcctcccctgagctctcccctaaacctttaggaaaatatgtggcaagcaaaagcctgttaagttgttttattgtagtagcaaccraggaactgagctaagtataaaacaaatcataaatacttaatgaaatgaaaaactaaaatctgatggcactcaaaatttgcattcatttcagaaatggcat

SEQ ID NO: 1542 - DNA, 201 bp, Homo sapiens; identical to SEQ ID NO: 747

SEQ ID NO: 1543 - DNA, 201 bp, Homo sapiens
aaatagaaatctttttgttttgtttgcactgattatcacacagattcaagagatgctccaggatgtagtgatttctgcagaacattagaagactttacaarctgtagtactttattaataccattgttttatgatatttgatactttaaaaattctattcaatgtatcataatgtctaaacatatccagacattgttttct

SEQ ID NO: 1544 - DNA, 201 bp, Homo sapiens
ctagcagataatggttgacttgaaaacaaaaaatctccttggaatgaaaaataggaaactaaattttggtcagtagtgccaattaattaagttattccccmatgctttccatatagtgtggcctcattaattatttgtcaaatttctgctagaattatagaagaaatgagaaaattattcttttgttcttgtgtctgcatt

SEQ ID NO: 1545 - DNA, 201 bp, Homo sapiens; identical to SEQ ID NO: 1164

SEQ ID NO: 1546 - DNA, 201 bp, Homo sapiens; identical to SEQ ID NO: 1165

SEQ ID NO: 1547 - DNA, 201 bp, Homo sapiens; identical to SEQ ID NO: 971

SEQ ID NO: 1548 - DNA, 201 bp, Homo sapiens
tagctatgatccaaaaatgtaaaagtaaataaacataataaaacaaatcaattaactgaaccaagcaaaccacactggaagcttttatcttgttctttccytcgttggcatcaaagtctggccactctttggagatttacacctgcggtggtttcattgccaaaatgccttcttcctaacacttatctctatgagagggtc

SEQ ID NO: 1549 - DNA, 201 bp, Homo sapiens
tgggtcttctgctgatggacagagacgttcttcactgagacacactttgtgaattcgggagtggtaatctctaccctcagagggcagtgggggtcagtcaytgaactcttattctaaaaaataaaaacattaaataaagttaaaattaaggatgctttatggaatttcagggtttcgatgatgtgtaaagctaatggcaac

SEQ ID NO: 1550 - DNA, 201 bp, Homo sapiens
acctcatgatccacctgcctcggcctcccaaagtgctgagataacaggtgtgagccaccacgcctggccatggtgttcttataaacaccagtcatattcartcaggggcctaccctattccagtatgacctcatcttaactaactctatctgcaacacccctatttccaaatcaggccacattgtggggtactggggattg

SEQ ID NO: 1551 - DNA, 201 bp, Homo sapiens; identical to SEQ ID NO: 1166

SEQ ID NO: 1552 - DNA, 201 bp, Homo sapiens; identical to SEQ ID NO: 667

SEQ ID NO: 1553 - DNA, 201 bp, Homo sapiens
atatatataaatctatatatatatatatatatataaatctttctgaaaatatatgcctcttaaagcaattatttaagaagaagattccaaatgttcatagytctccccgaatatacattatttttaagaatgtgattttggagaaattacacagaaatatatcaaaatttctataaatcaataataagttagcatatgcag

SEQ ID NO: 1554 - DNA, 201 bp, Homo sapiens; identical to SEQ ID NO: 671

SEQ ID NO: 1555 - DNA, 201 bp, Homo sapiens
ctgaagatacctggatataaagaagggggacgaagaagctagaaaaatgctgttgcaatattattttggccctacatttcccccagcattctgttgcccakaaattgatttgcatcactgtttgtcttgccttctcagttcctttggcaataacgattatattatccatctacttttcttttaaaaattcaaagtataaaa

SEQ ID NO: 1556 - DNA, 201 bp, Homo sapiens; identical to SEQ ID NO: 1051

SEQ ID NO: 1557 - DNA, 201 bp, Homo sapiens
caggccaaggaaaccactaatctactttcaatctctgtatgcttttattttctgaacatttcctgtcactgaaatcatgcaatatatagtcagagaaatakttttaaaacatgaatcaagatcatgtcactacgttgcctaaaatccttccatagctttcgtcagcacctagaataatatcccaattctttaccctggcta

SEQ ID NO: 1558 - DNA, 201 bp, Homo sapiens; identical to SEQ ID NO: 1045

SEQ ID NO: 1559 - DNA, 201 bp, Homo sapiens
ttgctaagtactctactgacatcattccagataatgacctttcaagataggtataattctccccattttacagatgcttaccataaaagggttaagtaacsctctcaaggttctttctctcacatgaagaaacattccttcccactgtactgacagtagagagaggaaaacttatataagctttactaatttcctctccca

SEQ ID NO: 1560 - DNA, 201 bp, Homo sapiens
cagctccagtataatcttaggggaccatcatcctatatgcggtcgcttgttgactgatacatcattatgcggtgcatgactgcataaatttgggtatggayatagatatagacagagatatcttcagccctgaacagtctccttaactccatacttaaatacctgctggatatttccaccaaatgtttcatatgcatttga

SEQ ID NO: 1561 - DNA, 201 bp, Homo sapiens; identical to SEQ ID NO: 1052

SEQ ID NO: 1562 - DNA, 201 bp, Homo sapiens
gcacagatacgatttgaaaagaggagaaatttaccattggtagagggttggatttatctggaaggtgaattgggcgggaagaaaagtcaagagaatgtgcrcttggattggagaaaaatgttgcaggaagggaacatcctcagggcaaattgcatgttgagaagttctgctgtccattaggaatgggaaggccctgtggaa

SEQ ID NO: 1563 - DNA, 201 bp, Homo sapiens; identical to SEQ ID NO: 1053

SEQ ID NO: 1564 - DNA, 201 bp, Homo sapiens
ctatttcattagctgctcctgctcagcctcctttgctcgttccttctcatttccttggcctcttgatgttgtagggcttagtctttgattgtcttctcttktctctctatacttgttcacttggggatctcattctgtctcatggttttaaatgttacctacaagtcgttgaatagatagatacaaagagtcaatcattgc

SEQ ID NO: 1565 - DNA, 201 bp, Homo sapiens; identical to SEQ ID NO: 1211

SEQ ID NO: 1566 - DNA, 201 bp, Homo sapiens; identical to SEQ ID NO: 1212

SEQ ID NO: 1567 - DNA, 17 bp, Homo sapiens
ctgcagcctctcctacg

SEQ ID NO: 1568 - DNA, 18 bp, Homo sapiens
cctgcagcctctcctaca

SEQ ID NO: 1569 - DNA, 19 bp, Homo sapiens
gattccccatcggtcataa

SEQ ID NO: 1570 - DNA, 17 bp, Homo sapiens
ttgcagagaagcgttcc

SEQ ID NO: 1571 - DNA, 19 bp, Homo sapiens
ctttgcagagaagcgttct

SEQ ID NO: 1572 - DNA, 24 bp, Homo sapiens
ctgagctttgtgaagagaaactga

SEQ ID NO: 1573 - DNA, 19 bp, Homo sapiens
gacaaactgagggacaacg

SEQ ID NO: 1574 - DNA, 19 bp, Homo sapiens
gacaaactgagggacaaca

SEQ ID NO: 1575 - DNA, 21 bp, Homo sapiens
cctctgacagacgcttcttga

SEQ ID NO: 1576 - DNA, 16 bp, Homo sapiens
ggaaggtcatcctggg

SEQ ID NO: 1577 - DNA, 16 bp, Homo sapiens
ggaaggtcatcctgga

SEQ ID NO: 1578 - DNA, 23 bp, Homo sapiens
cgaagagtttctgtgtggtacag

SEQ ID NO: 1579 - DNA, 17 bp, Homo sapiens
tgagacgggtggtaacc

SEQ ID NO: 1580 - DNA, 18 bp, Homo sapiens
ttgagacgggtggtaact

SEQ ID NO: 1581 - DNA, 24 bp, Homo sapiens
cagctttgaagggcatccatatga

SEQ ID NO: 1582 - DNA, 15 bp, Homo sapiens
tcccacaccacctgc

SEQ ID NO: 1583 - DNA, 16 bp, Homo sapiens
ctcccacaccacctgt

SEQ ID NO: 1584 - DNA, 23 bp, Homo sapiens
gccaccacaatgtctctcaatac

SEQ ID NO: 1585 - DNA, 17 bp, Homo sapiens
ccgctccgcacttaaag

SEQ ID NO: 1586 - DNA, 17 bp, Homo sapiens
ccgctccgcacttaaaa

SEQ ID NO: 1587 - DNA, 19 bp, Homo sapiens
cctgcagctggacagactc

SEQ ID NO: 1588 - DNA, 24 bp, Homo sapiens
taaagaatgcataaattagtgtgg

SEQ ID NO: 1589 - DNA, 25 bp, Homo sapiens
ttaaagaatgcataaattagtgtgt

SEQ ID NO: 1590 - DNA, 25 bp, Homo sapiens
gatcctaattggatttgaagactta

SEQ ID NO: 1591 - DNA, 15 bp, Homo sapiens
atcgcccatgtgctg

SEQ ID NO: 1592 - DNA, 16 bp, Homo sapiens
catcgcccatgtgctt

SEQ ID NO: 1593 - DNA, 20 bp, Homo sapiens
tcaaaccaggaaccctatct

SEQ ID NO: 1594 - DNA, 18 bp, Homo sapiens
ctgtaaacgctggtctgg

SEQ ID NO: 1595 - DNA, 19 bp, Homo sapiens
actgtaaacgctggtctgt

SEQ ID NO: 1596 - DNA, 23 bp, Homo sapiens
ccttgtccctgattgcttcttca

SEQ ID NO: 1597 - DNA, 15 bp, Homo sapiens
ccccgcttcaacacg

SEQ ID NO: 1598 - DNA, 16 bp, Homo sapiens
tccccgcttcaacaca

SEQ ID NO: 1599 - DNA, 24 bp, Homo sapiens
aacttcattcggcacttgctacaa

SEQ ID NO: 1600 - DNA, 21 bp, Homo sapiens
agtacctcttggtctctctcc

SEQ ID NO: 1601 - DNA, 21 bp, Homo sapiens
agtacctcttggtctctctcg

SEQ ID NO: 1602 - DNA, 23 bp, Homo sapiens
gcatgttgtgtttctgattgtac

SEQ ID NO: 1603 - DNA, 17 bp, Homo sapiens
aaagggccgagctgata

SEQ ID NO: 1604 - DNA, 15 bp, Homo sapiens
agggccgagctgatg

SEQ ID NO: 1605 - DNA, 22 bp, Homo sapiens
gggaggtttggagagagagtat

SEQ ID NO: 1606 - DNA, 15 bp, Homo sapiens
gaccgtggtcccttg

SEQ ID NO: 1607 - DNA, 16 bp, Homo sapiens
tgaccgtggtcccttt

SEQ ID NO: 1608 - DNA, 15 bp, Homo sapiens
cgcccggagacagaa

SEQ ID NO: 1609 - DNA, 22 bp, Homo sapiens
tagcaactgctatcaatgacag

SEQ ID NO: 1610 - DNA, 22 bp, Homo sapiens
tagcaactgctatcaatgacat

SEQ ID NO: 1611 - DNA, 25 bp, Homo sapiens
agtgaaggagttaactgagtgtgta

SEQ ID NO: 1612 - DNA, 16 bp, Homo sapiens
tgggtcccaagctcat

SEQ ID NO: 1613 - DNA, 16 bp, Homo sapiens
tgggtcccaagctcac

SEQ ID NO: 1614 - DNA, 15 bp, Homo sapiens
ggctcgccgacactg

SEQ ID NO: 1615 - DNA, 22 bp, Homo sapiens
acatttataccatttcccgagt

SEQ ID NO: 1616 - DNA, 22 bp, Homo sapiens
acatttataccatttcccgagc

SEQ ID NO: 1617 - DNA, 27 bp, Homo sapiens
gcctaacaacagtacctactccatagg

SEQ ID NO: 1618 - DNA, 24 bp, Homo sapiens
catttgtcctaaaagtacctctct

SEQ ID NO: 1619 - DNA, 24 bp, Homo sapiens
catttgtcctaaaagtacctctcc

SEQ ID NO: 1620 - DNA, 23 bp, Homo sapiens
caaggctaagcatgctgaacaca

SEQ ID NO: 1621 - DNA, 17 bp, Homo sapiens
tgctaaggcctgtgaac

SEQ ID NO: 1622 - DNA, 18 bp, Homo sapiens
ttgctaaggcctgtgaat

SEQ ID NO: 1623 - DNA, 20 bp, Homo sapiens
tctgttttcgctggagtctt

SEQ ID NO: 1624 - DNA, 22 bp, Homo sapiens
acaccctgacacctcttttact

SEQ ID NO: 1625 - DNA, 20 bp, Homo sapiens
accctgacacctcttttacg

SEQ ID NO: 1626 - DNA, 21 bp, Homo sapiens
cgttccagtccatattcacat

SEQ ID NO: 1627 - DNA, 21 bp, Homo sapiens
atttcctccctcacatgatac

SEQ ID NO: 1628 - DNA, 21 bp, Homo sapiens
atttcctccctcacatgatat

SEQ ID NO: 1629 - DNA, 23 bp, Homo sapiens
tcaaagaatgaagagtgaagaca

SEQ ID NO: 1630 - DNA, 14 bp, Homo sapiens
acgctgctgttccg

SEQ ID NO: 1631 - DNA, 14 bp, Homo sapiens
acgctgctgttcca

SEQ ID NO: 1632 - DNA, 24 bp, Homo sapiens
cagacagacaacaattcagaagaa

SEQ ID NO: 1633 - DNA, 23 bp, Homo sapiens
tgaagactgattgttgtacttgc

SEQ ID NO: 1634 - DNA, 24 bp, Homo sapiens
ctgaagactgattgttgtacttga

SEQ ID NO: 1635 - DNA, 20 bp, Homo sapiens
tggtggagagggttgtagaa

SEQ ID NO: 1636 - DNA, 18 bp, Homo sapiens
gagttttcgccatccact

SEQ ID NO: 1637 - DNA, 16 bp, Homo sapiens
gttttcgccatccacc

SEQ ID NO: 1638 - DNA, 23 bp, Homo sapiens
gaatctgcttcatttgaatctct

SEQ ID NO: 1639 - DNA, 20 bp, Homo sapiens
ttggtgtttccttgtgacac

SEQ ID NO: 1640 - DNA, 20 bp, Homo sapiens
ttggtgtttccttgtgacat

SEQ ID NO: 1641 - DNA, 25 bp, Homo sapiens
cctagtgtttgcaatctcatttatc

SEQ ID NO: 1642 - DNA, 18 bp, Homo sapiens
cactcctaagtgagcagc

SEQ ID NO: 1643 - DNA, 20 bp, Homo sapiens
atcactcctaagtgagcagt

SEQ ID NO: 1644 - DNA, 24 bp, Homo sapiens
ctgcttcagtgttatctcagtctt

SEQ ID NO: 1645 - DNA, 20 bp, Homo sapiens
ccaccaggatgtaacagtcc

SEQ ID NO: 1646 - DNA, 21 bp, Homo sapiens
cccaccaggatgtaacagtct

SEQ ID NO: 1647 - DNA, 18 bp, Homo sapiens
tgtggatgcagcagtgac

SEQ ID NO: 1648 - DNA, 21 bp, Homo sapiens
caagaagttcacagctgaaga

SEQ ID NO: 1649 - DNA, 20 bp, Homo sapiens
aagaagttcacagctgaagg

SEQ ID NO: 1650 - DNA, 20 bp, Homo sapiens
cctgctggagagacagagtg

SEQ ID NO: 1651 - DNA, 17 bp, Homo sapiens
ggcaggggtgagattga

SEQ ID NO: 1652 - DNA, 17 bp, Homo sapiens
ggcaggggtgagattgg

SEQ ID NO: 1653 - DNA, 23 bp, Homo sapiens
gtcgtgaggtcagatgctatgag

SEQ ID NO: 1654 - DNA, 30 bp, Homo sapiens
cttaaatattacctgttctaattttctctg

SEQ ID NO: 1655 - DNA, 31 bp, Homo sapiens
ccttaaatattacctgttctaattttctcta

SEQ ID NO: 1656 - DNA, 30 bp, Homo sapiens
gaaatgctgtgggaacataaactaactagg

SEQ ID NO: 1657 - DNA, 30 bp, Homo sapiens
gagcaatagtaagtatacacaatgaaataa

SEQ ID NO: 1658 - DNA, 30 bp, Homo sapiens
gagcaatagtaagtatacacaatgaaatac

SEQ ID NO: 1659 - DNA, 26 bp, Homo sapiens
gatcacgggcctctagattgattaca

SEQ ID NO: 1660 - DNA, 15 bp, Homo sapiens
gaggagcccgttgca

SEQ ID NO: 1661 - DNA, 14 bp, Homo sapiens
aggagcccgttgcg

SEQ ID NO: 1662 - DNA, 18 bp, Homo sapiens
tcaccatgcacaaggaca

SEQ ID NO: 1663 - DNA, 18 bp, Homo sapiens
tggacaacagcaccttat

SEQ ID NO: 1664 - DNA, 18 bp, Homo sapiens
tggacaacagcaccttac

SEQ ID NO: 1665 - DNA, 20 bp, Homo sapiens
ttccagaggttccttcaatc

SEQ ID NO: 1666 - DNA, 18 bp, Homo sapiens
cccctcaagcactctgac

SEQ ID NO: 1667 - DNA, 18 bp, Homo sapiens
cccctcaagcactctgat

SEQ ID NO: 1668 - DNA, 20 bp, Homo sapiens
tctgcccctcgtctttctct

SEQ ID NO: 1669 - DNA, 21 bp, Homo sapiens
ggctttacagaaggaaatgct

SEQ ID NO: 1670 - DNA, 20 bp, Homo sapiens
gctttacagaaggaaatgcc

SEQ ID NO: 1671 - DNA, 22 bp, Homo sapiens
gcatgcgctgaattttatatag

SEQ ID NO: 1672 - DNA, 23 bp, Homo sapiens
cagccgtttcttcatataatcca

SEQ ID NO: 1673 - DNA, 22 bp, Homo sapiens
agccgtttcttcatataatccg

SEQ ID NO: 1674 - DNA, 27 bp, Homo sapiens
cttgctaattcattctgtgacctcaat

SEQ ID NO: 1675 - DNA, 18 bp, Homo sapiens
gcgcctttctgtgtagtt

SEQ ID NO: 1676 - DNA, 18 bp, Homo sapiens
gcgcctttctgtgtagtc

SEQ ID NO: 1677 - DNA, 29 bp, Homo sapiens
cacaacagttgttaagttgttagcaaacc

SEQ ID NO: 1678 - DNA, 19 bp, Homo sapiens
ttcaggccatcttgcaaat

SEQ ID NO: 1679 - DNA, 18 bp, Homo sapiens
tcaggccatcttgcaaac

SEQ ID NO: 1680 - DNA, 25 bp, Homo sapiens
ctcatggcccgatgattttcagtta

SEQ ID NO: 1681 - DNA, 18 bp, Homo sapiens
caggctcgtcttgaactc

SEQ ID NO: 1682 - DNA, 18 bp, Homo sapiens
caggctcgtcttgaactt

SEQ ID NO: 1683 - DNA, 22 bp, Homo sapiens
caagagtgggaactgcaggttt

SEQ ID NO: 1684 - DNA, 24 bp, Homo sapiens
gtgggagtcttatgtttgtagatg

SEQ ID NO: 1685 - DNA, 24 bp, Homo sapiens
gtgggagtcttatgtttgtagatt

SEQ ID NO: 1686 - DNA, 20 bp, Homo sapiens
gcttgacaatgcgcagttgt

SEQ ID NO: 1687 - DNA, 17 bp, Homo sapiens
ttctggggcatacaacg

SEQ ID NO: 1688 - DNA, 18 bp, Homo sapiens
cttctggggcatacaaca

SEQ ID NO: 1689 - DNA, 19 bp, Homo sapiens
agggacaaccctccataaa

SEQ ID NO: 1690 - DNA, 20 bp, Homo sapiens
agtggagatttagcaccaga

SEQ ID NO: 1691 - DNA, 19 bp, Homo sapiens
gtggagatttagcaccagg

SEQ ID NO: 1692 - DNA, 26 bp, Homo sapiens
gtacattttggattgggagaggatat

SEQ ID NO: 1693 - DNA, 16 bp, Homo sapiens
cgagtcggtctgctgc

SEQ ID NO: 1694 - DNA, 16 bp, Homo sapiens
cgagtcggtctgctga

SEQ ID NO: 1695 - DNA, 20 bp, Homo sapiens
tgcctacctcattccatctg

SEQ ID NO: 1696 - DNA, 23 bp, Homo sapiens
cctaccttgaattcacctatctg

SEQ ID NO: 1697 - DNA, 23 bp, Homo sapiens
cctaccttgaattcacctatcta

SEQ ID NO: 1698 - DNA, 22 bp, Homo sapiens
catttccaaatcagaaacatga

SEQ ID NO: 1699 - DNA, 19 bp, Homo sapiens
gcaacttgttgaatgccag

SEQ ID NO: 1700 - DNA, 19 bp, Homo sapiens
gcaacttgttgaatgccac

SEQ ID NO: 1701 - DNA, 23 bp, Homo sapiens
gtgctgtcacacccaagaagtac

SEQ ID NO: 1702 - DNA, 17 bp, Homo sapiens
ggttgggcgtaagggtt

SEQ ID NO: 1703 - DNA, 17 bp, Homo sapiens
ggttgggcgtaagggtc

SEQ ID NO: 1704 - DNA, 23 bp, Homo sapiens
ccctagctttgcataaatcatac

SEQ ID NO: 1705 - DNA, 20 bp, Homo sapiens
gtggaaatgcaagctcttca

SEQ ID NO: 1706 - DNA, 19 bp, Homo sapiens
tggaaatgcaagctcttcc

SEQ ID NO: 1707 - DNA, 25 bp, Homo sapiens
ccagatcgctttggtaaaggattaa

SEQ ID NO: 1708 - DNA, 23 bp, Homo sapiens
atttaagcatcatagcataccac

SEQ ID NO: 1709 - DNA, 23 bp, Homo sapiens
atttaagcatcatagcataccat

SEQ ID NO: 1710 - DNA, 25 bp, Homo sapiens
tggtacaccataaatcttgacttac

SEQ ID NO: 1711 - DNA, 21 bp, Homo sapiens
atcttcacagtgttccacatc

SEQ ID NO: 1712 - DNA, 21 bp, Homo sapiens
atcttcacagtgttccacatt

SEQ ID NO: 1713 - DNA, 20 bp, Homo sapiens
ttctgacctccaggttcttt

SEQ ID NO: 1714 - DNA, 17 bp, Homo sapiens
ggcaggcgaagagtcac

SEQ ID NO: 1715 - DNA, 17 bp, Homo sapiens
ggcaggcgaagagtcat

SEQ ID NO: 1716 - DNA, 22 bp, Homo sapiens
gggtcaatccacagtctagatg

SEQ ID NO: 1717 - DNA, 20 bp, Homo sapiens
tgagcaggtagcctgtattt

SEQ ID NO: 1718 - DNA, 20 bp, Homo sapiens
tgagcaggtagcctgtattc

SEQ ID NO: 1719 - DNA, 17 bp, Homo sapiens
tgctgccttggttgtga

SEQ ID NO: 1720 - DNA, 16 bp, Homo sapiens
cggatcttctccagcg

SEQ ID NO: 1721 - DNA, 17 bp, Homo sapiens
ccggatcttctccagca

SEQ ID NO: 1722 - DNA, 21 bp, Homo sapiens
tgaagccacatccttctttat

SEQ ID NO: 1723 - DNA, 21 bp, Homo sapiens
tttcaagctgtctcctaccat

SEQ ID NO: 1724 - DNA, 21 bp, Homo sapiens
tttcaagctgtctcctaccac

SEQ ID NO: 1725 - DNA, 22 bp, Homo sapiens
ggagagaagggaaggactaaag

SEQ ID NO: 1726 - DNA, 14 bp, Homo sapiens
gcggctctgcacat

SEQ ID NO: 1727 - DNA, 14 bp, Homo sapiens
gcggctctgcacac

SEQ ID NO: 1728 - DNA, 17 bp, Homo sapiens
gcgggtggctcctttaa

SEQ ID NO: 1729 - DNA, 16 bp, Homo sapiens
ggtcctgcttgatgcg

SEQ ID NO: 1730 - DNA, 17 bp, Homo sapiens
aggtcctgcttgatgcc

SEQ ID NO: 1731 - DNA, 19 bp, Homo sapiens
cgaccatggacattcacat

SEQ ID NO: 1732 - DNA, 19 bp, Homo sapiens
ctgcctcttctgcattaga

SEQ ID NO: 1733 - DNA, 18 bp, Homo sapiens
tgcctcttctgcattagg

SEQ ID NO: 1734 - DNA, 20 bp, Homo sapiens
ccttcactgcctgtttctct

SEQ ID NO: 1735 - DNA, 25 bp, Homo sapiens
gggaagttctttcttgtatattcaa

SEQ ID NO: 1736 - DNA, 25 bp, Homo sapiens
gggaagttctttcttgtatattcag

SEQ ID NO: 1737 - DNA, 21 bp, Homo sapiens
tgctgtctttgcctcactaat

SEQ ID NO: 1738 - DNA, 21 bp, Homo sapiens
aatcagcatttttgtcaaaga

SEQ ID NO: 1739 - DNA, 20 bp, Homo sapiens
atcagcatttttgtcaaagg

SEQ ID NO: 1740 - DNA, 20 bp, Homo sapiens
ggcttgtgacctcattgttt

SEQ ID NO: 1741 - DNA, 18 bp, Homo sapiens
aatgcagctgctcaaaga

SEQ ID NO: 1742 - DNA, 17 bp, Homo sapiens
atgcagctgctcaaagg

SEQ ID NO: 1743 - DNA, 15 bp, Homo sapiens
gttcccgggctcaca

SEQ ID NO: 1744 - DNA, 19 bp, Homo sapiens
ccctgcctctgtctgacta

SEQ ID NO: 1745 - DNA, 19 bp, Homo sapiens
ccctgcctctgtctgactc

SEQ ID NO: 1746 - DNA, 18 bp, Homo sapiens
aagacaagcccaggttca

SEQ ID NO: 1747 - DNA, 20 bp, Homo sapiens
ccatcatttactcctaccgc

SEQ ID NO: 1748 - DNA, 21 bp, Homo sapiens
cccatcatttactcctaccgt

SEQ ID NO: 1749 - DNA, 15 bp, Homo sapiens
gccgagcggtctgag

SEQ ID NO: 1750 - DNA, 21 bp, Homo sapiens
acatcccaataaaagagcagg

SEQ ID NO: 1751 - DNA, 23 bp, Homo sapiens
aaacatcccaataaaagagcaga

SEQ ID NO: 1752 - DNA, 31 bp, Homo sapiens
actttgtttctttcagtatttatggcagtgg

SEQ ID NO: 1753 - DNA, 19 bp, Homo sapiens
gaaatcctcccactgatga

SEQ ID NO: 1754 - DNA, 18 bp, Homo sapiens
aaatcctcccactgatgg

SEQ ID NO: 1755 - DNA, 26 bp, Homo sapiens
gccagatagaatgactttattgtaga

SEQ ID NO: 1756 - DNA, 23 bp, Homo sapiens
gtcaaatctaagctgagtgttga

SEQ ID NO: 1757 - DNA, 22 bp, Homo sapiens
tcaaatctaagctgagtgttgg

SEQ ID NO: 1758 - DNA, 24 bp, Homo sapiens
gctttcccagatgcactgtattgt

SEQ ID NO: 1759 - DNA, 18 bp, Homo sapiens
tctcgggtagaccacact

SEQ ID NO: 1760 - DNA, 17 bp, Homo sapiens
ctcgggtagaccacacc

SEQ ID NO: 1761 - DNA, 22 bp, Homo sapiens
ggcccagagaggtgaagttact

SEQ ID NO: 1762 - DNA, 19 bp, Homo sapiens
gagttgctcacaaaaggca

SEQ ID NO: 1763 - DNA, 18 bp, Homo sapiens
agttgctcacaaaaggcg

SEQ ID NO: 1764 - DNA, 23 bp, Homo sapiens
gcaggccatgtgaatagacatac

SEQ ID NO: 1765 - DNA, 16 bp, Homo sapiens
atcctggtatggcccc

SEQ ID NO: 1766 - DNA, 17 bp, Homo sapiens
catcctggtatggccct

SEQ ID NO: 1767 - DNA, 25 bp, Homo sapiens
gtcacacaagccaagaagaattaga

SEQ ID NO: 1768 - DNA, 16 bp, Homo sapiens
gcagccagtttctccc

SEQ ID NO: 1769 - DNA, 17 bp, Homo sapiens
tgcagccagtttctcct

SEQ ID NO: 1770 - DNA, 21 bp, Homo sapiens
catgaaatgcttccaggtatt

SEQ ID NO: 1771 - DNA, 22 bp, Homo sapiens
ctgacctcctgaataatccatc

SEQ ID NO: 1772 - DNA, 23 bp, Homo sapiens
tctgacctcctgaataatccatt

SEQ ID NO: 1773 - DNA, 21 bp, Homo sapiens
cagggcttccctagcagatag

SEQ ID NO: 1774 - DNA, 18 bp, Homo sapiens
aacagccattccttgtcc

SEQ ID NO: 1775 - DNA, 19 bp, Homo sapiens
gaacagccattccttgtct

SEQ ID NO: 1776 - DNA, 23 bp, Homo sapiens
ccagaagcagatgaaatgagtac

SEQ ID NO: 1777 - DNA, 18 bp, Homo sapiens
gctcccaacactggacag

SEQ ID NO: 1778 - DNA, 18 bp, Homo sapiens
gctcccaacactggacac

SEQ ID NO: 1779 - DNA, 17 bp, Homo sapiens
ggtggcagagctctcct

SEQ ID NO: 1780 - DNA, 19 bp, Homo sapiens
ggcccccatacattacaac

SEQ ID NO: 1781 - DNA, 19 bp, Homo sapiens
ggcccccatacattacaat

SEQ ID NO: 1782 - DNA, 23 bp, Homo sapiens
tggaggaaagttctggacagtta

SEQ ID NO: 1783 - DNA, 18 bp, Homo sapiens
ggattcgagccgacatct

SEQ ID NO: 1784 - DNA, 17 bp, Homo sapiens
gattcgagccgacatcc

SEQ ID NO: 1785 - DNA, 25 bp, Homo sapiens
ttgaggattagcctagaaccacaca

SEQ ID NO: 1786 - DNA, 20 bp, Homo sapiens
cgacccatgagagaatcaga

SEQ ID NO: 1787 - DNA, 20 bp, Homo sapiens
cgacccatgagagaatcagg

SEQ ID NO: 1788 - DNA, 18 bp, Homo sapiens
gcaggtccagccagtgaa

SEQ ID NO: 1789 - DNA, 22 bp, Homo sapiens
atgtgaaattgcatgcacttag

SEQ ID NO: 1790 - DNA, 24 bp, Homo sapiens
gtatgtgaaattgcatgcacttaa

SEQ ID NO: 1791 - DNA, 28 bp, Homo sapiens
tgtgtgtacaacacctatacatgtgtgt

SEQ ID NO: 1792 - DNA, 24 bp, Homo sapiens
catgagactcaacttcttaggaaa

SEQ ID NO: 1793 - DNA, 24 bp, Homo sapiens
catgagactcaacttcttaggaat

SEQ ID NO: 1794 - DNA, 25 bp, Homo sapiens
gcaccagccaaggtttactttatag

SEQ ID NO: 1795 - DNA, 22 bp, Homo sapiens
cttgctaccaattccattttcc

SEQ ID NO: 1796 - DNA, 22 bp, Homo sapiens
cttgctaccaattccattttcg

SEQ ID NO: 1797 - DNA, 20 bp, Homo sapiens
ggatctcaggggcaagtctt

SEQ ID NO: 1798 - DNA, 25 bp, Homo sapiens
tcaacaaatgtattgatcagcaaac

SEQ ID NO: 1799 - DNA, 26 bp, Homo sapiens
ctcaacaaatgtattgatcagcaaat

SEQ ID NO: 1800 - DNA, 23 bp, Homo sapiens
cagacaggaggagtgggattcat

SEQ ID NO: 1801 - DNA, 19 bp, Homo sapiens
gaagaagtacaacccacat

SEQ ID NO: 1802 - DNA, 19 bp, Homo sapiens
gaagaagtacaacccacag

SEQ ID NO: 1803 - DNA, 25 bp, Homo sapiens
gacacatgtaagttccactcatatg

SEQ ID NO: 1804 - DNA, 18 bp, Homo sapiens
aaggtgagcttgccaatc

SEQ ID NO: 1805 - DNA, 18 bp, Homo sapiens
aaggtgagcttgccaatt

SEQ ID NO: 1806 - DNA, 21 bp, Homo sapiens
catggcgaggaagacacatat

SEQ ID NO: 1807 - DNA, 21 bp, Homo sapiens
ggtgggccttttgaaataaac

SEQ ID NO: 1808 - DNA, 22 bp, Homo sapiens
tggtgggccttttgaaataaat

SEQ ID NO: 1809 - DNA, 23 bp, Homo sapiens
cttgaagtgaaggcacctgtcat

SEQ ID NO: 1810 - DNA, 16 bp, Homo sapiens
accacagctgtccctc

SEQ ID NO: 1811 - DNA, 17 bp, Homo sapiens
taccacagctgtccctt

SEQ ID NO: 1812 - DNA, 18 bp, Homo sapiens
gcctcccagtgggaatct

SEQ ID NO: 1813 - DNA, 23 bp, Homo sapiens
tccagttagggataaagaaagga

SEQ ID NO: 1814 - DNA, 22 bp, Homo sapiens
ccagttagggataaagaaaggc

SEQ ID NO: 1815 - DNA, 21 bp, Homo sapiens
ccaggctgatctcgaacttct

SEQ ID NO: 1816 - DNA, 25 bp, Homo sapiens
gaagatagattctgccaaatcattc

SEQ ID NO: 1817 - DNA, 25 bp, Homo sapiens
gaagatagattctgccaaatcattt

SEQ ID NO: 1818 - DNA, 23 bp, Homo sapiens
ggtaaactcctgttgcctcagta

SEQ ID NO: 1819 - DNA, 19 bp, Homo sapiens
acacctgcggttagattga

SEQ ID NO: 1820 - DNA, 18 bp, Homo sapiens
cacctgcggttagattgg

SEQ ID NO: 1821 - DNA, 21 bp, Homo sapiens
cgaagcttcacagatgacatc

SEQ ID NO: 1822 - DNA, 21 bp, Homo sapiens
ctttcttgacatcagtgcttc

SEQ ID NO: 1823 - DNA, 21 bp, Homo sapiens
ctttcttgacatcagtgcttg

SEQ ID NO: 1824 - DNA, 26 bp, Homo sapiens
caaagtcctccttttccttgactctg

SEQ ID NO: 1825 - DNA, 20 bp, Homo sapiens
agctgctgcttgctaaatat

SEQ ID NO: 1826 - DNA, 20 bp, Homo sapiens
agctgctgcttgctaaatac

SEQ ID NO: 1827 - DNA, 26 bp, Homo sapiens
cctggaaaggtcatgctactcatact

SEQ ID NO: 1828 - DNA, 19 bp, Homo sapiens
tggcaggagatggatgtac

SEQ ID NO: 1829 - DNA, 19 bp, Homo sapiens
tggcaggagatggatgtag

SEQ ID NO: 1830 - DNA, 26 bp, Homo sapiens
ccagttacttgacttttggcgtttct

SEQ ID NO: 1831 - DNA, 23 bp, Homo sapiens
tctagcagatttgtatcagaacc

SEQ ID NO: 1832 - DNA, 26 bp, Homo sapiens
taatctagcagatttgtatcagaact

SEQ ID NO: 1833 - DNA, 21 bp, Homo sapiens
gcgaccctctctggttaaaca

SEQ ID NO: 1834 - DNA, 19 bp, Homo sapiens
tcctgtctctgtccctttc

SEQ ID NO: 1835 - DNA, 20 bp, Homo sapiens
atcctgtctctgtccctttt

SEQ ID NO: 1836 - DNA, 18 bp, Homo sapiens
cggagtgccctcttgtct

SEQ ID NO: 1837 - DNA, 17 bp, Homo sapiens
tgactcccagcatgaat

SEQ ID NO: 1838 - DNA, 17 bp, Homo sapiens
tgactcccagcatgaac

SEQ ID NO: 1839 - DNA, 22 bp, Homo sapiens
tggcttatcaagagacatgaga

SEQ ID NO: 1840 - DNA, 22 bp, Homo sapiens
agagatagtggaagctttgaca

SEQ ID NO: 1841 - DNA, 21 bp, Homo sapiens
gagatagtggaagctttgacg

SEQ ID NO: 1842 - DNA, 24 bp, Homo sapiens
cctgcagcacactttgtaatctac

SEQ ID NO: 1843 - DNA, 18 bp, Homo sapiens
cctgggcaacaaagtcac

SEQ ID NO: 1844 - DNA, 18 bp, Homo sapiens
cctgggcaacaaagtcag

SEQ ID NO: 1845 - DNA, 27 bp, Homo sapiens
caagaatattggcctgcttcaaactag

SEQ ID NO: 1846 - DNA, 16 bp, Homo sapiens
ccttggggtagtcccc

SEQ ID NO: 1847 - DNA, 17 bp, Homo sapiens
tccttggggtagtccct

SEQ ID NO: 1848 - DNA, 18 bp, Homo sapiens
gctggagtcccactgaga

SEQ ID NO: 1849 - DNA, 19 bp, Homo sapiens
tgtaattggcccagaacac

SEQ ID NO: 1850 - DNA, 20 bp, Homo sapiens
atgtaattggcccagaacat

SEQ ID NO: 1851 - DNA, 21 bp, Homo sapiens
ccttccaggcttctctctgat

SEQ ID NO: 1852 - DNA, 23 bp, Homo sapiens
gttggtgaagaaggatttgtagt

SEQ ID NO: 1853 - DNA, 23 bp, Homo sapiens
gttggtgaagaaggatttgtaga

SEQ ID NO: 1854 - DNA, 24 bp, Homo sapiens
gctggaagcttgacacttgttgaa

SEQ ID NO: 1855 - DNA, 18 bp, Homo sapiens
tgtgccttccacatctca

SEQ ID NO: 1856 - DNA, 18 bp, Homo sapiens
tgtgccttccacatctct

SEQ ID NO: 1857 - DNA, 21 bp, Homo sapiens
caggctttggtctgggttaaa

SEQ ID NO: 1858 - DNA, 24 bp, Homo sapiens
gcatacatcacattttctttacct

SEQ ID NO: 1859 - DNA, 24 bp, Homo sapiens
gcatacatcacattttctttaccc

SEQ ID NO: 1860 - DNA, 26 bp, Homo sapiens
gttcattgcagcattttccccaatac

SEQ ID NO: 1861 - DNA, 24 bp, Homo sapiens
aaaccaggatatcagaacatttta

SEQ ID NO: 1862 - DNA, 22 bp, Homo sapiens
accaggatatcagaacattttg

SEQ ID NO: 1863 - DNA, 25 bp, Homo sapiens
ggtcttaggaattatctgacatctt

SEQ ID NO: 1864 - DNA, 18 bp, Homo sapiens
caactactcgggagacag

SEQ ID NO: 1865 - DNA, 18 bp, Homo sapiens
caactactcgggagacac

SEQ ID NO: 1866 - DNA, 24 bp, Homo sapiens
cctctcagccctctctccataaag

SEQ ID NO: 1867 - DNA, 21 bp, Homo sapiens
gtatgggcttgaggaaatcac

SEQ ID NO: 1868 - DNA, 21 bp, Homo sapiens
gtatgggcttgaggaaatcat

SEQ ID NO: 1869 - DNA, 22 bp, Homo sapiens
tgcacagatggcttctgtatgt

SEQ ID NO: 1870 - DNA, 21 bp, Homo sapiens
aactacttctggatggtcagc

SEQ ID NO: 1871 - DNA, 22 bp, Homo sapiens
aaactacttctggatggtcagt

SEQ ID NO: 1872 - DNA, 23 bp, Homo sapiens
gggtcctgcaagtagacactaag

SEQ ID NO: 1873 - DNA, 23 bp, Homo sapiens
tcaaaattatttcttgctacagg

SEQ ID NO: 1874 - DNA, 24 bp, Homo sapiens
gtcaaaattatttcttgctacaga

SEQ ID NO: 1875 - DNA, 18 bp, Homo sapiens
tcctccagcctctcattc

SEQ ID NO: 1876 - DNA, 25 bp, Homo sapiens
cagtagcaatggtaaagatttgaat

SEQ ID NO: 1877 - DNA, 25 bp, Homo sapiens
cagtagcaatggtaaagatttgaac

SEQ ID NO: 1878 - DNA, 29 bp, Homo sapiens
ttccactgtatagactctcctgtacagat

SEQ ID NO: 1879 - DNA, 16 bp, Homo sapiens
ggctctctcgtgagca

SEQ ID NO: 1880 - DNA, 16 bp, Homo sapiens
ggctctctcgtgagcg

SEQ ID NO: 1881 - DNA, 22 bp, Homo sapiens
gaaggggcacagtgccttttag

SEQ ID NO: 1882 - DNA, 19 bp, Homo sapiens
gcagctgaggatttagcac

SEQ ID NO: 1883 - DNA, 19 bp, Homo sapiens
gcagctgaggatttagcat

SEQ ID NO: 1884 - DNA, 22 bp, Homo sapiens
cagagcaagaccctgtctctaa

SEQ ID NO: 1885 - DNA, 19 bp, Homo sapiens
cgtcagctccttttgacac

SEQ ID NO: 1886 - DNA, 19 bp, Homo sapiens
cgtcagctccttttgacat

SEQ ID NO: 1887 - DNA, 21 bp, Homo sapiens
ccccagagggtccaaatttct

SEQ ID NO: 1888 - DNA, 22 bp, Homo sapiens
cttggatagcctgaaccaataa

SEQ ID NO: 1889 - DNA, 22 bp, Homo sapiens
cttggatagcctgaaccaatat

SEQ ID NO: 1890 - DNA, 22 bp, Homo sapiens
cgtgaatagggtccagagtcta

SEQ ID NO: 1891 - DNA, 17 bp, Homo sapiens
tttggacatgggcaagc

SEQ ID NO: 1892 - DNA, 18 bp, Homo sapiens
ctttggacatgggcaagg

SEQ ID NO: 1893 - DNA, 24 bp, Homo sapiens
ccctgcatggaaaggtaagaaagt

SEQ ID NO: 1894 - DNA, 28 bp, Homo sapiens
ctcatccttaatattgtttacttgtgat

SEQ ID NO: 1895 - DNA, 28 bp, Homo sapiens
ctcatccttaatattgtttacttgtgac

SEQ ID NO: 1896 - DNA, 20 bp, Homo sapiens
caagacagccgcctacaaga

SEQ ID NO: 1897 - DNA, 16 bp, Homo sapiens
gcaggggtttctcacc

SEQ ID NO: 1898 - DNA, 17 bp, Homo sapiens
tgcaggggtttctcact

SEQ ID NO: 1899 - DNA, 18 bp, Homo sapiens
ccctccggctcaatgtca

SEQ ID NO: 1900 - DNA, 16 bp, Homo sapiens
ctcgggaccagtccag

SEQ ID NO: 1901 - DNA, 16 bp, Homo sapiens
ctcgggaccagtccaa

SEQ ID NO: 1902 - DNA, 16 bp, Homo sapiens
ccgacagccgaggaga

SEQ ID NO: 1903 - DNA, 19 bp, Homo sapiens
cgccacaaacacatacctg

SEQ ID NO: 1904 - DNA, 19 bp, Homo sapiens
cgccacaaacacatacctt

SEQ ID NO: 1905 - DNA, 16 bp, Homo sapiens
ccgctgcttggaacag

SEQ ID NO: 1906 - DNA, 19 bp, Homo sapiens
agactttgatgccaacgag

SEQ ID NO: 1907 - DNA, 20 bp, Homo sapiens
cagactttgatgccaacgaa

SEQ ID NO: 1908 - DNA, 25 bp, Homo sapiens
ccaagcacatttattgagcactcaa

SEQ ID NO: 1909 - DNA, 24 bp, Homo sapiens
caaacagtgatgcaaatcaatttc

SEQ ID NO: 1910 - DNA, 25 bp, Homo sapiens
acaaacagtgatgcaaatcaattta

SEQ ID NO: 1911 - DNA, 23 bp, Homo sapiens
gaagggggacgaagaagctagaa

SEQ ID NO: 1912 - DNA, 19 bp, Homo sapiens
gggaccctataggagcttc

SEQ ID NO: 1913 - DNA, 19 bp, Homo sapiens
gggaccctataggagcttt

SEQ ID NO: 1914 - DNA, 24 bp, Homo sapiens
tcattcttgggggagaggctattc
